United States Patent 11,384,138 (METHODS OF GENERATING ANTIBODIES) - sequence listing, part 2

SEQ ID NO: 564 - protein, 296 aa, Homo sapiens
  SITE (11)..(11): Xaa at position 11 is Val, Ala, Gly, Leu, or Ile
  SITE (12)..(12): Xaa at position 12 is Val, Ala, Gly, Leu, or Ile
  SITE (13)..(13): Xaa at position 13 is Val, Ala, Gly, Leu, or Ile
  SITE (14)..(14): Xaa at position 14 is Val, Ala, Gly, Leu, or Ile
  SITE (16)..(16): Xaa at position 16 is Val, Ala, Gly, Leu, or Ile
  SITE (42)..(42): Xaa at position 42 is Phe, Tyr, Met, His, Ile, Leu, Val Ala, or Gly
  SITE (62)..(62): Xaa at position 62 is Ala, Gly, or Pro
  SITE (70)..(70): Xaa at position 70 is Val, Ala, Gly, Leu, or Ile
  SITE (71)..(71): Xaa at position 71 is Ala, Gly, or Pro
  SITE (72)..(72): Xaa at position 72 is Tyr, Phe, Met, His, Ile, Leu, Val Ala, or Gly
  SITE (73)..(73): Xaa at position 73 is Ile, Ala, Val, Leu, or Gly
  SITE (80)..(80): Xaa at position 80 is His, Phe, Tyr, Lys, Arg, Gly, Ser Thr, Ala, Val, Leu, Ile, Asn, Met, or Gln
  SITE (84)..(84): Xaa at position 84 is Ile, Ala, Val, Leu, or Gly
  SITE (87)..(87): Xaa at position 87 is Phe, Tyr, Met, His, Ile, Leu, Val Ala, or Gly
  SITE (88)..(88): Xaa at position 88 is Leu, Ala, Val, Gly, or Ile
  SITE (94)..(94): Xaa at position 94 is Val, Ala, Gly, Leu, or Ile
  SITE (95)..(95): Xaa at position 95 is Leu, Ala, Val, Gly, or Ile
  SITE (96)..(96): Xaa at position 96 is Val, Ala, Gly, Leu, or Ile
  SITE (100)..(100): Xaa at position 100 is Met, Ile, Leu, Val, Ala, or Gly
  SITE (107)..(107): Xaa at position 107 is Ala, Gly, or Pro
  SITE (110)..(110): Xaa at position 110 is Leu, Ala, Val, Gly, or Ile
  SITE (122)..(122): Xaa at position 122 is His, Phe, Tyr, Lys, Arg, Gly, Ser Thr, Ala, Val, Leu, Ile, Asn, Met, or Gln
  SITE (136)..(136): Xaa at position 136 is Leu, Ala, Val, Gly, or Ile
  SITE (150)..(150): Xaa at position 150 is Leu, Ala, Val, Gly, or Ile
  SITE (166)..(166): Xaa at position 166 is Ala, Gly, or Pro
  SITE (167)..(167): Xaa at position 167 is Phe, Tyr, Met, His, Ile, Leu, Val Ala, or Gly
  SITE (170)..(170): Xaa at position 170 is Ile, Ala, Val, Leu, or Gly
  SITE (173)..(173): Xaa at position 173 is Leu, Ala, Val, Gly, or Ile
  SITE (175)..(175): Xaa at position 175 is Trp, Tyr, Phe, Met, His, Ile, Leu Val, Ala, or Gly
  SITE (176)..(176): Xaa at position 176 is Leu, Ala, Val, Gly, or Ile
  SITE (201)..(201): Xaa at position 201 is Met, Ile, Leu, Val, Ala, or Gly
  SITE (203)..(203): Xaa at position 203 is Val, Ala, Gly, Leu, or Ile
  SITE (205)..(205): Xaa at position 205 is Leu, Ala, Val, Gly, or Ile
  SITE (213)..(213): Xaa at position 213 is Leu, Ala, Val, Gly, or Ile
  SITE (215)..(215): Xaa at position 215 is Trp, Tyr, Phe, Met, His, Ile, Leu Val, Ala, or Gly
  SITE (231)..(231): Xaa at position 231 is Phe, Tyr, Met, His, Ile, Leu, Val Ala, or Gly
  SITE (258)..(258): Xaa at position 258 is Phe, Tyr, Met, His, Ile, Leu, Val Ala, or Gly
  SITE (278)..(278): Xaa at position 278 is Ile, Ala, Val, Leu, or Gly
  SITE (281)..(281): Xaa at position 281 is Cys, Ala, Val, Gly, Ser, or Thr
  SITE (282)..(282): Xaa at position 282 is Leu, Ala, Val, Gly, or Ile
  SITE (285)..(285): Xaa at position 285 is Ala, Gly, or Pro
  SITE (288)..(288): Xaa at position 288 is Ile, Ala, Val, Leu, or Gly
MNAEPERKFGXXXXGXGRAGSVRMRDLRNPHPSSAFLNLIGXVSRRELGSIDGVQQISLEDXLSSQEVEXXXXCSESSSXEDYXRQXXNAGKHXXXEYPXTLSLAAXQEXWELAEQKGKVLXEEHVELLMEEFAFXKKEVVGKDLLKGSXLFTAGPLEEERFGFPXXSGXSRXTXXVSLFGELSLVSATLEERKEDQYMKXTXCXETEKKSPXSXIEEKGPGLKRNRYLSXHFKSGSLENVPNVGVNKNIFLKDQNIXVQKLLGQFSEKELAAEKKRXLHXXGLXEEXQKYCCSRK

SEQ ID NO: 565 - protein, 1690 aa, Homo sapiens
  SITE (1468)..(1468): Xaa at position 1468 is Leu, Ala, Val, Gly, or Ile
  SITE (1494)..(1494): Xaa at position 1494 is Leu, Ala, Val, Gly, or Ile
  SITE (1495)..(1495): Xaa at position 1495 is Tyr, Phe, Met, His, Ile, Leu Val, Ala, or Gly
  SITE (1507)..(1507): Xaa at position 1507 is Leu, Ala, Val, Gly, or Ile
  SITE (1541)..(1541): Xaa at position 1541 is Tyr, Phe, Met, His, Ile, Leu Val, Ala, or Gly
  SITE (1542)..(1542): Xaa at position 1542 is Trp, Tyr, Phe, Met, His, Ile Leu, Val, Ala, or Gly
  SITE (1543)..(1543): Xaa at position 1543 is Leu, Ala, Val, Gly, or Ile
  SITE (1563)..(1563): Xaa at position 1563 is Val, Ala, Gly, Leu, or Ile
  SITE (1566)..(1566): Xaa at position 1566 is Cys, Ala, Val, Gly, Ser, or Thr
  SITE (1567)..(1567): Xaa at position 1567 is Ala, Gly, or Pro
  SITE (1568)..(1568): Xaa at position 1568 is Val, Ala, Gly, Leu, or Ile
  SITE (1569)..(1569): Xaa at position 1569 is Cys, Ala, Val, Gly, Ser, or Thr
  SITE (1571)..(1571): Xaa at position 1571 is Ala, Gly, or Pro
  SITE (1601)..(1601): Xaa at position 1601 is Phe, Tyr, Met, His, Ile, Leu Val, Ala, or Gly
  SITE (1604)..(1604): Xaa at position 1604 is His, Phe, Tyr, Lys, Arg, Gly Ser, Thr, Ala, Val, Leu, Ile, Asn, Met, or Gln
  SITE (1622)..(1622): Xaa at position 1622 is Cys, Ala, Val, Gly, Ser, or Thr
  SITE (1631)..(1631): Xaa at position 1631 is Phe, Tyr, Met, His, Ile, Leu Val, Ala, or Gly
  SITE (1632)..(1632): Xaa at position 1632 is Leu, Ala, Val, Gly, or Ile
  SITE (1634)..(1634): Xaa at position 1634 is Cys, Ala, Val, Gly, Ser, or Thr
  SITE (1641)..(1641): Xaa at position 1641 is Cys, Ala, Val, Gly, Ser, or Thr
  SITE (1683)..(1683): Xaa at position 1683 is Cys, Ala, Val, Gly, Ser, or Thr
  SITE (1685)..(1685): Xaa at position 1685 is Val, Ala, Gly, Leu, or Ile
  SITE (1686)..(1686): Xaa at position 1686 is Cys, Ala, Val, Gly, Ser, or Thr
  SITE (1687)..(1687): Xaa at position 1687 is Val, Ala, Gly, Leu, or Ile
MWSLHIVLMRCSFRLTKSLATGPWSLILILFSVQYVYGSGKKYIGPCGGRDCSVCHCVPEKGSRGPPGPPGPQGPIGPLGAPGPIGLSGEKGMRGDRGPPGAAGDKGDKGPTGVPGFPGLDGIPGHPGPPGPRGKPGMSGHNGSRGDPGFPGGRGALGPGGPLGHPGEKGEKGNSVFILGAVKGIQGDRGDPGLPGLPGSWGAGGPAGPTGYPGEPGLVGPPGQPGRPGLKGNPGVGVKGQMGDPGEVGQQGSPGPTLLVEPPDFCLYKGEKGIKGIPGMVGLPGPPGRKGESGIGAKGEKGIPGFPGPRGDPGSYGSPGFPGLKGELGLVGDPGLFGLIGPKGDPGNRGHPGPPGVLVTPPLPLKGPPGDPGFPGRYGETGDVGPPGPPGLLGRPGEACAGMIGPPGPQGFPGLPGLPGEAGIPGRPDSAPGKPGKPGSPGLPGAPGLQGLPGSSVIYCSVGNPGPQGIKGKVGPPGGRGPKGEKGNEGLCACEPGPMGPPGPPGLPGRQGSKGDLGLPGWLGTKGDPGPPGAEGPPGLPGKHGASGPPGNKGAKGDMVVSRVKGHKGERGPDGPPGFPGQPGSHGRDGHAGEKGDPGPPGDHEDATPGGKGFPGPLGPPGKAGPVGPPGLGFPGPPGERGHPGVPGHPGVRGPDGLKGQKGDTISCNVTYPGRHGPPGFDGPPGPKGFPGPQGAPGLSGSDGHKGRPGTPGTAEIPGPPGFRGDMGDPGFGGEKGSSPVGPPGPPGSPGVNGQKGIPGDPAFGHLGPPGKRGLSGVPGIKGPRGDPGCPGAEGPAGIPGFLGLKGPKGREGHAGFPGVPGPPGHSCERGAPGIPGQPGLPGYPGSPGAPGGKGQPGDVGPPGPAGMKGLPGLPGRPGAHGPPGLPGIPGPFGDDGLPGPPGPKGPRGLPGFPGFPGERGKPGAEGCPGAKGEPGEKGMSGLPGDRGLRGAKGAIGPPGDEGEMAIISQKGTPGEPGPPGDDGFPGERGDKGTPGMQGRRGEPGRYGPPGFHRGEPGEKGQPGPPGPPGPPGSTGLRGFIGFPGLPGDQGEPGSPGPPGFSGIDGARGPKGNKGDPASHFGPPGPKGEPGSPGCPGHFGASGEQGLPGIQGPRGSPGRPGPPGSSGPPGCPGDHGMPGLRGQPGEMGDPGPRGLQGDPGIPGPPGIKGPSGSPGLNGLHGLKGQKGTKGASGLHDVGPPGPVGIPGLKGERGDPGSPGISPPGPRGKKGPPGPPGSSGPPGPAGATGRAPKDIPDPGPPGDQGPPGPDGPRGAPGPPGLPGSVDLLRGEPGDCGLPGPPGPPGPPGPPGYKGFPGCDGKDGQKGPVGFPGPQGPHGFPGPPGEKGLPGPPGRKGPTGLPGPRGEPGPPADVDDCPRIPGLPGAPGMRGPEGAMGLPGMRGPSGPGCKGEPGLDGRRGVDGVPGSPGPPGRKGDTGEDGYPGGPGPPGPIGDPGPKGFGPGYLGGFLXVLHSQTDQEPTCPLGMPRLWTGYSLXXLEGQEKAHNQDXGLAGSCLPVFSTLPFAYCNIHQVCHYAQRNDRSXXXASAAPLPMMPLSEEAIRPYXSRXXXXEXPAQAVAVHSQDQSIPPCPQTWRSLWIGYSXLMXTGAGDQGGGQALMSPGSXLEDFRAAPXXEXQGRQGTXHFFANKYSFWLTTVKADLQFSSAPAPDTLKESQAQRQKISRXQXXXKYS

SEQ ID NO: 566 - protein, 463 aa, Homo sapiens
  SITE (30)..(30): Xaa at position 30 is Cys, Ala, Val, Gly, Ser, or Thr
  SITE (35)..(35): Xaa at position 35 is Leu, Ala, Val, Gly, or Ile
  SITE (39)..(39): Xaa at position 39 is Trp, Tyr, Phe, Met, His, Ile, Leu Val, Ala, or Gly
  SITE (41)..(41): Xaa at position 41 is Phe, Tyr, Met, His, Ile, Leu, Val Ala, or Gly
  SITE (66)..(66): Xaa at position 66 is Val, Ala, Gly, Leu, or Ile
  SITE (68)..(68): Xaa at position 68 is Leu, Ala, Val, Gly, or Ile
  SITE (74)..(74): Xaa at position 74 is Ala, Gly, or Pro
  SITE (84)..(84): Xaa at position 84 is Phe, Tyr, Met, His, Ile, Leu, Val Ala, or Gly
  SITE (86)..(86): Xaa at position 86 is Ile, Ala, Val, Leu, or Gly
  SITE (87)..(87): Xaa at position 87 is Ile, Ala, Val, Leu, or Gly
  SITE (92)..(92): Xaa at position 92 is Phe, Tyr, Met, His, Ile, Leu, Val Ala, or Gly
  SITE (94)..(94): Xaa at position 94 is Ile, Ala, Val, Leu, or Gly
  SITE (102)..(102): Xaa at position 102 is Phe, Tyr, Met, His, Ile, Leu, Val Ala, or Gly
  SITE (103)..(103): Xaa at position 103 is Ala, Gly, or Pro
  SITE (105)..(105): Xaa at position 105 is Phe, Tyr, Met, His, Ile, Leu, Val Ala, or Gly
  SITE (127)..(127): Xaa at position 127 is His, Phe, Tyr, Lys, Arg, Gly, Ser Thr, Ala, Val, Leu, Ile, Asn, Met, or Gln
  SITE (134)..(134): Xaa at position 134 is Trp, Tyr, Phe, Met, His, Ile, Leu Val, Ala, or Gly
  SITE (136)..(136): Xaa at position 136 is Cys, Ala, Val, Gly, Ser, or Thr
  SITE (137)..(137): Xaa at position 137 is Phe, Tyr, Met, His, Ile, Leu, Val Ala, or Gly
  SITE (259)..(259): Xaa at position 259 is Tyr, Phe, Met, His, Ile, Leu, Val Ala, or Gly
  SITE (262)..(262): Xaa at position 262 is Ala, Gly, or Pro
  SITE (264)..(264): Xaa at position 264 is Met, Ile, Leu, Val, Ala, or Gly
  SITE (266)..(266): Xaa at position 266 is Met, Ile, Leu, Val, Ala, or Gly
  SITE (269)..(269): Xaa at position 269 is Ala, Gly, or Pro
  SITE (271)..(271): Xaa at position 271 is Ile, Ala, Val, Leu, or Gly
  SITE (283)..(283): Xaa at position 283 is Leu, Ala, Val, Gly, or Ile
  SITE (288)..(288): Xaa at position 288 is Val, Ala, Gly, Leu, or Ile
  SITE (294)..(294): Xaa at position 294 is Tyr, Phe, Met, His, Ile, Leu, Val Ala, or Gly
  SITE (304)..(304): Xaa at position 304 is Tyr, Phe, Met, His, Ile, Leu, Val Ala, or Gly
  SITE (305)..(305): Xaa at position 305 is Leu, Ala, Val, Gly, or Ile
  SITE (306)..(306): Xaa at position 306 is Ile, Ala, Val, Leu, or Gly
  SITE (307)..(307): Xaa at position 307 is Ala, Gly, or Pro
  SITE (311)..(311): Xaa at position 311 is Ala, Gly, or Pro
  SITE (316)..(316): Xaa at position 316 is Leu, Ala, Val, Gly, or Ile
  SITE (317)..(317): Xaa at position 317 is Val, Ala, Gly, Leu, or Ile
  SITE (347)..(347): Xaa at position 347 is Tyr, Phe, Met, His, Ile, Leu, Val Ala, or Gly
  SITE (352)..(352): Xaa at position 352 is Tyr, Phe, Met, His, Ile, Leu, Val Ala, or Gly
  SITE (360)..(360): Xaa at position 360 is Met, Ile, Leu, Val, Ala, or Gly
  SITE (364)..(364): Xaa at position 364 is Leu, Ala, Val, Gly, or Ile
  SITE (370)..(370): Xaa at position 370 is Met, Ile, Leu, Val, Ala, or Gly
  SITE (371)..(371): Xaa at position 371 is Ala, Gly, or Pro
  SITE (372)..(372): Xaa at position 372 is Val, Ala, Gly, Leu, or Ile
  SITE (374)..(374): Xaa at position 374 is Phe, Tyr, Met, His, Ile, Leu, Val Ala, or Gly
  SITE (380)..(380): Xaa at position 380 is Phe, Tyr, Met, His, Ile, Leu, Val Ala, or Gly
  SITE (407)..(407): Xaa at position 407 is Val, Ala, Gly, Leu, or Ile
  SITE (408)..(408): Xaa at position 408 is Leu, Ala, Val, Gly, or Ile
  SITE (409)..(409): Xaa at position 409 is Leu, Ala, Val, Gly, or Ile
  SITE (410)..(410): Xaa at position 410 is Val, Ala, Gly, Leu, or Ile
  SITE (423)..(423): Xaa at position 423 is Trp, Tyr, Phe, Met, His, Ile, Leu Val, Ala, or Gly
  SITE (425)..(425): Xaa at position 425 is Val, Ala, Gly, Leu, or Ile
  SITE (439)..(439): Xaa at position 439 is Phe, Tyr, Met, His, Ile, Leu, Val Ala, or Gly
  SITE (441)..(441): Xaa at position 441 is Ile, Ala, Val, Leu, or Gly
  SITE (450)..(450): Xaa at position 450 is Ile, Ala, Val, Leu, or Gly
  SITE (454)..(454): Xaa at position 454 is Ala, Gly, or Pro
  SITE (456)..(456): Xaa at position 456 is Ala, Gly, or Pro
  SITE (457)..(457): Xaa at position 457 is Ala, Gly, or Pro
MGAGPSLLLAALLLLLSGDGAVRCDTPANXTYLDXLGTXVXQVGSSGSQRDVNCSVMGPQEKKVVXYXQKLDTXYDDLGNSGHXTXXYNQGXEXVLNDYKWXXFXKYKEEGSKVTTYCNETMTGWVXDVLGRNXAXXTGKKVGTASENVYVNIAHLKNSQEKYSNRLYKYDHNFVKAINAIQKSWTATTYMEYETLTLGDMIRRSGGHSRKIPRPKPAPLTAEIQQKILHLPTSWDWRNVHGINFVSPVRNQASCGSCXSFXSXGXLEXRXRILTNNSQTPIXSPQEXVSCSQXAQGCEGGFPXXXXGKYXQDFGXXEEACFPYTGTDSPCKMKEDCFRYYSSEYHXVGGFXGGCNEALXKLEXVHHGPXXXAXEVYDDXLHYKKGIYHHTGLRDPFNPFELTNHAXXXXGYGTDSASGMDYXIXKNSWGTGWGENGYXRXRRGTDECAXESIXVXXTPIPKL

SEQ ID NO: 567 - protein, 1239 aa, Homo sapiens
  SITE (139)..(139): Xaa at position 139 is Phe, Tyr, Met, His, Ile, Leu, Val Ala, or Gly
  SITE (143)..(143): Xaa at position 143 is Ala, Gly, or Pro
  SITE (153)..(153): Xaa at position 153 is Ala, Gly, or Pro
  SITE (157)..(157): Xaa at position 157 is Leu, Ala, Val, Gly, or Ile
  SITE (175)..(175): Xaa at position 175 is Trp, Tyr, Phe, Met, His, Ile, Leu Val, Ala, or Gly
  SITE (178)..(178): Xaa at position 178 is Tyr, Phe, Met, His, Ile, Leu, Val Ala, or Gly
  SITE (194)..(194): Xaa at position 194 is Ala, Gly, or Pro
  SITE (195)..(195): Xaa at position 195 is Leu, Ala, Val, Gly, or Ile
  SITE (196)..(196): Xaa at position 196 is Val, Ala, Gly, Leu, or Ile
  SITE (197)..(197): Xaa at position 197 is Phe, Tyr, Met, His, Ile, Leu, Val Ala, or Gly
  SITE (202)..(202): Xaa at position 202 is Cys, Ala, Val, Gly, Ser, or Thr
  SITE (212)..(212): Xaa at position 212 is Ala, Gly, or Pro
  SITE (213)..(213): Xaa at position 213 is Val, Ala, Gly, Leu, or Ile
  SITE (214)..(214): Xaa at position 214 is Ala, Gly, or Pro
  SITE (215)..(215): Xaa at position 215 is Ile, Ala, Val, Leu, or Gly
  SITE (219)..(219): Xaa at position 219 is Ala, Gly, or Pro
  SITE (220)..(220): Xaa at position 220 is Trp, Tyr, Phe, Met, His, Ile, Leu Val, Ala, or Gly
  SITE (224)..(224): Xaa at position 224 is Cys, Ala, Val, Gly, Ser, or Thr
  SITE (242)..(242): Xaa at position 242 is Ala, Gly, or Pro
  SITE (244)..(244): Xaa at position 244 is Leu, Ala, Val, Gly, or Ile
  SITE (253)..(253): Xaa at position 253 is Ala, Gly, or Pro
  SITE (265)..(265): Xaa at position 265 is Leu, Ala, Val, Gly, or Ile
  SITE (266)..(266): Xaa at position 266 is Val, Ala, Gly, Leu, or Ile
  SITE (267)..(267): Xaa at position 267 is Val, Ala, Gly, Leu, or Ile
  SITE (276)..(276): Xaa at position 276 is Ala, Gly, or Pro
  SITE (278)..(278): Xaa at position 278 is Ile, Ala, Val, Leu, or Gly
  SITE (282)..(282): Xaa at position 282 is Tyr, Phe, Met, His, Ile, Leu, Val Ala, or Gly
  SITE (289)..(289): Xaa at position 289 is Met, Ile, Leu, Val, Ala, or Gly
  SITE (297)..(297): Xaa at position 297 is Met, Ile, Leu, Val, Ala, or Gly
  SITE (298)..(298): Xaa at position 298 is His, Phe, Tyr, Lys, Arg, Gly, Ser Thr, Ala, Val, Leu, Ile, Asn, Met, or Gln
  SITE (300)..(300): Xaa at position 300 is Ala, Gly, or Pro
  SITE (301)..(301): Xaa at position 301 is Ile, Ala, Val, Leu, or Gly
  SITE (304)..(304): Xaa at position 304 is Leu, Ala, Val, Gly, or Ile
  SITE (359)..(359): Xaa at position 359 is Val, Ala, Gly, Leu, or Ile
  SITE (393)..(393): Xaa at position 393 is Met, Ile, Leu, Val, Ala, or Gly
  SITE (397)..(397): Xaa at position 397 is Ala, Gly, or Pro
  SITE (400)..(400): Xaa at position 400 is Val, Ala, Gly, Leu, or Ile
  SITE (406)..(406): Xaa at position 406 is Val, Ala, Gly, Leu, or Ile
  SITE (407)..(407): Xaa at position 407 is Phe, Tyr, Met, His, Ile, Leu, Val Ala, or Gly
  SITE (422)..(422): Xaa at position 422 is Val, Ala, Gly, Leu, or Ile
  SITE (425)..(425): Xaa at position 425 is Ala, Gly, or Pro
  SITE (427)..(427): Xaa at position 427 is Met, Ile, Leu, Val, Ala, or Gly
  SITE (428)..(428): Xaa at position 428 is Leu, Ala, Val, Gly, or Ile
  SITE (432)..(432): Xaa at position 432 is Val, Ala, Gly, Leu, or Ile
  SITE (434)..(434): Xaa at position 434 is Tyr, Phe, Met, His, Ile, Leu, Val Ala, or Gly
  SITE (435)..(435): Xaa at position 435 is Leu, Ala, Val, Gly, or Ile
  SITE (437)..(437): Xaa at position 437 is Val, Ala, Gly, Leu, or Ile
  SITE (441)..(441): Xaa at position 441 is Trp, Tyr, Phe, Met, His, Ile, Leu Val, Ala, or Gly
  SITE (448)..(448): Xaa at position 448 is Ala, Gly, or Pro
  SITE (463)..(463): Xaa at position 463 is Leu, Ala, Val, Gly, or Ile
  SITE (467)..(467): Xaa at position 467 is Ala, Gly, or Pro
  SITE (610)..(610): Xaa at position 610 is Phe, Tyr, Met, His, Ile, Leu, Val Ala, or Gly
  SITE (798)..(798): Xaa at position 798 is Ile, Ala, Val, Leu, or Gly
  SITE (801)..(801): Xaa at position 801 is Trp, Tyr, Phe, Met, His, Ile, Leu Val, Ala, or Gly
  SITE (804)..(804): Xaa at position 804 is Ala, Gly, or Pro
  SITE (808)..(808): Xaa at position 808 is Ile, Ala, Val, Leu, or Gly
  SITE (839)..(839): Xaa at position 839 is Ala, Gly, or Pro
  SITE (841)..(841): Xaa at position 841 is Leu, Ala, Val, Gly, or Ile
  SITE (847)..(847): Xaa at position 847 is Ala, Gly, or Pro
  SITE (870)..(870): Xaa at position 870 is Val, Ala, Gly, Leu, or Ile
  SITE (874)..(874): Xaa at position 874 is Leu, Ala, Val, Gly, or Ile
  SITE (876)..(876): Xaa at position 876 is Ala, Gly, or Pro
  SITE (878)..(878): Xaa at position 878 is Val, Ala, Gly, Leu, or Ile
  SITE (880)..(880): Xaa at position 880 is Ala, Gly, or Pro
  SITE (887)..(887): Xaa at position 887 is Val, Ala, Gly, Leu, or Ile
  SITE (889)..(889): Xaa at position 889 is Ala, Gly, or Pro
  SITE (891)..(891): Xaa at position 891 is Val, Ala, Gly, Leu, or Ile
  SITE (898)..(898): Xaa at position 898 is Ile, Ala, Val, Leu, or Gly
  SITE (899)..(899): Xaa at position 899 is Ala, Gly, or Pro
  SITE (900)..(900): Xaa at position 900 is Ala, Gly, or Pro
  SITE (902)..(902): Xaa at position 902 is Leu, Ala, Val, Gly, or Ile
  SITE (908)..(908): Xaa at position 908 is Ala, Gly, or Pro
  SITE (915)..(915): Xaa at position 915 is Ala, Gly, or Pro
  SITE (936)..(936): Xaa at position 936 is Ala, Gly, or Pro
  SITE (982)..(982): Xaa at position 982 is Ala, Gly, or Pro
  SITE (1045)..(1045): Xaa at position 1045 is Ala, Gly, or Pro
  SITE (1061)..(1061): Xaa at position 1061 is Leu, Ala, Val, Gly, or Ile
  SITE (1077)..(1077): Xaa at position 1077 is Cys, Ala, Val, Gly, Ser, or Thr
  SITE (1079)..(1079): Xaa at position 1079 is Ile, Ala, Val, Leu, or Gly
  SITE (1082)..(1082): Xaa at position 1082 is Ala, Gly, or Pro
  SITE (1099)..(1099): Xaa at position 1099 is Trp, Tyr, Phe, Met, His, Ile Leu, Val, Ala, or Gly
  SITE (1100)..(1100): Xaa at position 1100 is Val, Ala, Gly, Leu, or Ile
  SITE (1101)..(1101): Xaa at position 1101 is Val, Ala, Gly, Leu, or Ile
  SITE (1105)..(1105): Xaa at position 1105 is Ala, Gly, or Pro
  SITE (1106)..(1106): Xaa at position 1106 is Val, Ala, Gly, Leu, or Ile
  SITE (1108)..(1108): Xaa at position 1108 is Tyr, Phe, Met, His, Ile, Leu Val, Ala, or Gly
  SITE (1110)..(1110): Xaa at position 1110 is His, Phe, Tyr, Lys, Arg, Gly Ser, Thr, Ala, Val, Leu, Ile, Asn, Met, or Gln
  SITE (1111)..(1111): Xaa at position 1111 is Leu, Ala, Val, Gly, or Ile
  SITE (1113)..(1113): Xaa at position 1113 is Leu, Ala, Val, Gly, or Ile
  SITE (1114)..(1114): Xaa at position 1114 is Val, Ala, Gly, Leu, or Ile
  SITE (1115)..(1115): Xaa at position 1115 is Ala, Gly, or Pro
  SITE (1116)..(1116): Xaa at position 1116 is Met, Ile, Leu, Val, Ala, or Gly
  SITE (1119)..(1119): Xaa at position 1119 is Leu, Ala, Val, Gly, or Ile
  SITE (1130)..(1130): Xaa at position 1130 is Cys, Ala, Val, Gly, Ser, or Thr
  SITE (1139)..(1139): Xaa at position 1139 is Tyr, Phe, Met, His, Ile, Leu Val, Ala, or Gly
  SITE (1140)..(1140): Xaa at position 1140 is Leu, Ala, Val, Gly, or Ile
  SITE (1141)..(1141): Xaa at position 1141 is Val, Ala, Gly, Leu, or Ile
  SITE (1149)..(1149): Xaa at position 1149 is Ala, Gly, or Pro
  SITE (1150)..(1150): Xaa at position 1150 is Ala, Gly, or Pro
  SITE (1152)..(1152): Xaa at position 1152 is Ala, Gly, or Pro
  SITE (1153)..(1153): Xaa at position 1153 is Leu, Ala, Val, Gly, or Ile
  SITE (1162)..(1162): Xaa at position 1162 is Cys, Ala, Val, Gly, Ser, or Thr
  SITE (1163)..(1163): Xaa at position 1163 is Met, Ile, Leu, Val, Ala, or Gly
  SITE (1165)..(1165): Xaa at position 1165 is Ala, Gly, or Pro
  SITE (1168)..(1168): Xaa at position 1168 is Leu, Ala, Val, Gly, or Ile
  SITE (1178)..(1178): Xaa at position 1178 is Ala, Gly, or Pro
  SITE (1182)..(1182): Xaa at position 1182 is Ala, Gly, or Pro
  SITE (1183)..(1183): Xaa at position 1183 is Val, Ala, Gly, Leu, or Ile
  SITE (1197)..(1197): Xaa at position 1197 is Cys, Ala, Val, Gly, Ser, or Thr
  SITE (1217)..(1217): Xaa at position 1217 is Ala, Gly, or Pro
  SITE (1218)..(1218): Xaa at position 1218 is Leu, Ala, Val, Gly, or Ile
MSRLLWRKVAGATVGPGPVPAPGRWVSSSVPASDPSDGQRRRQQQQQQQQQQQQQPQQPQVLSSEGGQLRHNPLDIQMLSRGLHEQIFGQGGEMPGEAAVRRSVEHLQKHGLWGQPAVPLPDVELRLPPLYGDNLDQHXRLLXQKQSLPYLEXANLXLQAQLPPKPPAWAWAEGXTRXGPEGEAVPVAIPEERXXXXDVEVXLAEGTCPTLXXXXSPSXXYSWXSQRLVEERYSWTSQLSPXDXIPLEVPTGXSSPTQRDWQEQXXXGHNVSFDRXHXREQXLIQGSRXRFLDTMSXXMXXSGXSSFQRSLWIAAKQGKHKVQPPTKQGQKSQRKARRGPAISSWDWLDISSVNSLAEXHRLYVGGPPLEKEPRELFVKGTMKDIRENFQDLXQYCXQDXWATHEXXQQQLPLFLERCPHPXTLXGXXEMGXSXXPXNQNXERYLAEXQGTYEELQREMKKSXMDLXNDACQLLSGERYKEDPWLWDLEWDLQEFKQKKAKKVKKEPATASKLPIEGAGAPGDPMDQEDLGPCSEEEEFQQDVMARACLQKLKGTTELLPKRPQHLPGHPGWYRKLCPRLDDPAWTPGPSLLSLQMRVTPKLMALTWDGXPLHYSERHGWGYLVPGRRDNLAKLPTGTTLESAGVVCPYRAIESLYRKHCLEQGKQQLMPQEAGLAEEFLLTDNSAIWQTVEELDYLEVEAEAKMENLRAAVPGQPLALTARGGPKDTQPSYHHGNGPYNDVDIPGCWFFKLPHKDGNSCNVGSPFAKDFLPKMEDGTLQAGPGGASGPRALEINKMXSFXRNXHKRXSSQMVVWLPRSALPRAVIRHPDYDEEGLYGXIXPQVVTXGTITRRAVEPTWLTASNARPDRXGSEXKXMXQXPPGYTLXGXDXDSQELWXXXVXGDAHFXGMHGCTXFGWMTLQGRKSRGTDLHSKTXTTVGISREHAKIFNYGRIYGAGQPFAERLLMQFNHRLTQQEAAEKXQQMYAATKGLRWYRLSDEGEWLVRELNLPVDRTEGGWISLQDLRKVQRETARKSQWKKWEVVXERAWKGGTESEMFNKXESIATSDIPRTPVLGXCXSRXLEPSAVQEEFMTSRVNXXXQSSXXDXLXXMXXXXKWXFEEFAIDGRFXISIHDEVRXXXREEDRYRXXLXXQITNLLTRXXFXYKXGLNDLPQSVXFFSXXDIDRCLRKEVTMDXKTPSNPTGMERRYGIPQGEXXDIYQIIELTKGSLEKRSQPGP

SEQ ID NO: 568 - protein, 528 aa, Homo sapiens
  SITE (14)..(14): Xaa at position 14 is Ile, Ala, Val, Leu, or Gly
  SITE (27)..(27): Xaa at position 27 is Leu, Ala, Val, Gly, or Ile
  SITE (36)..(36): Xaa at position 36 is Leu, Ala, Val, Gly, or Ile
  SITE (38)..(38): Xaa at position 38 is Ile, Ala, Val, Leu, or Gly
  SITE (39)..(39): Xaa at position 39 is Tyr, Phe, Met, His, Ile, Leu, Val Ala, or Gly
  SITE (53)..(53): Xaa at position 53 is Phe, Tyr, Met, His, Ile, Leu, Val Ala, or Gly
  SITE (56)..(56): Xaa at position 56 is Met, Ile, Leu, Val, Ala, or Gly
  SITE (59)..(59): Xaa at position 59 is Ile, Ala, Val, Leu, or Gly
  SITE (62)..(62): Xaa at position 62 is Phe, Tyr, Met, His, Ile, Leu, Val Ala, or Gly
  SITE (67)..(67): Xaa at position 67 is Cys, Ala, Val, Gly, Ser, or Thr
  SITE (69)..(69): Xaa at position 69 is Val, Ala, Gly, Leu, or Ile
  SITE (71)..(71): Xaa at position 71 is Ile, Ala, Val, Leu, or Gly
  SITE (73)..(73): Xaa at position 73 is Phe, Tyr, Met, His, Ile, Leu, Val Ala, or Gly
  SITE (77)..(77): Xaa at position 77 is His, Phe, Tyr, Lys, Arg, Gly, Ser Thr, Ala, Val, Leu, Ile, Asn, Met, or Gln
  SITE (78)..(78): Xaa at position 78 is Ala, Gly, or Pro
  SITE (85)..(85): Xaa at position 85 is Ala, Gly, or Pro
  SITE (94)..(94): Xaa at position 94 is Val, Ala, Gly, Leu, or Ile
  SITE (96)..(96): Xaa at position 96 is Tyr, Phe, Met, His, Ile, Leu, Val Ala, or Gly
  SITE (97)..(97): Xaa at position 97 is Tyr, Phe, Met, His, Ile, Leu, Val Ala, or Gly
  SITE (100)..(100): Xaa at position 100 is Val, Ala, Gly, Leu, or Ile
  SITE (101)..(101): Xaa at position 101 is Ile, Ala, Val, Leu, or Gly
  SITE (104)..(104): Xaa at position 104 is Met, Ile, Leu, Val, Ala, or Gly
  SITE (105)..(105): Xaa at position 105 is Leu, Ala, Val, Gly, or Ile
  SITE (129)..(129): Xaa at position 129 is Tyr, Phe, Met, His, Ile, Leu, Val Ala, or Gly
  SITE (136)..(136): Xaa at position 136 is Leu, Ala, Val, Gly, or Ile
  SITE (171)..(171): Xaa at position 171 is Ala, Gly, or Pro
  SITE (172)..(172): Xaa at position 172 is Leu, Ala, Val, Gly, or Ile
  SITE (181)..(181): Xaa at position 181 is Ala, Gly, or Pro
  SITE (183)..(183): Xaa at position 183 is Phe, Tyr, Met, His, Ile, Leu, Val Ala, or Gly
  SITE (191)..(191): Xaa at position 191 is Ile, Ala, Val, Leu, or Gly
  SITE (192)..(192): Xaa at position 192 is Phe, Tyr, Met, His, Ile, Leu, Val Ala, or Gly
  SITE (195)..(195): Xaa at position 195 is Ala, Gly, or Pro
  SITE (199)..(199): Xaa at position 199 is Leu, Ala, Val, Gly, or Ile
  SITE (208)..(208): Xaa at position 208 is Val, Ala, Gly, Leu, or Ile
  SITE (209)..(209): Xaa at position 209 is His, Phe, Tyr, Lys, Arg, Gly, Ser Thr, Ala, Val, Leu, Ile, Asn, Met, or Gln
  SITE (210)..(210): Xaa at position 210 is Leu, Ala, Val, Gly, or Ile
  SITE (211)..(211): Xaa at position 211 is Met, Ile, Leu, Val, Ala, or Gly
  SITE (232)..(232): Xaa at position 232 is Ile, Ala, Val, Leu, or Gly
  SITE (234)..(234): Xaa at position 234 is Leu, Ala, Val, Gly, or Ile
  SITE (241)..(241): Xaa at position 241 is Val, Ala, Gly, Leu, or Ile
  SITE (245)..(245): Xaa at position 245 is Leu, Ala, Val, Gly, or Ile
  SITE (260)..(260): Xaa at position 260 is Val, Ala, Gly, Leu, or Ile
  SITE (261)..(261): Xaa at position 261 is Leu, Ala, Val, Gly, or Ile
  SITE (264)..(264): Xaa at position 264 is Ile, Ala, Val, Leu, or Gly
  SITE (267)..(267): Xaa at position 267 is Val, Ala, Gly, Leu, or Ile
  SITE (277)..(277): Xaa at position 277 is Ile, Ala, Val, Leu, or Gly
  SITE (289)..(289): Xaa at position 289 is Tyr, Phe, Met, His, Ile, Leu, Val Ala, or Gly
  SITE (295)..(295): Xaa at position 295 is Leu, Ala, Val, Gly, or Ile
  SITE (299)..(299): Xaa at position 299 is Phe, Tyr, Met, His, Ile, Leu, Val Ala, or Gly
  SITE (304)..(304): Xaa at position 304 is Val, Ala, Gly, Leu, or Ile
  SITE (309)..(309): Xaa at position 309 is Leu, Ala, Val, Gly, or Ile
  SITE (313)..(313): Xaa at position 313 is Val, Ala, Gly, Leu, or Ile
  SITE (317)..(317): Xaa at position 317 is Leu, Ala, Val, Gly, or Ile
  SITE (321)..(321): Xaa at position 321 is Leu, Ala, Val, Gly, or Ile
  SITE (324)..(324): Xaa at position 324 is Ile, Ala, Val, Leu, or Gly
  SITE (336)..(336): Xaa at position 336 is Leu, Ala, Val, Gly, or Ile
  SITE (339)..(339): Xaa at position 339 is Ala, Gly, or Pro
  SITE (340)..(340): Xaa at position 340 is Ala, Gly, or Pro
  SITE (370)..(370): Xaa at position 370 is Ile, Ala, Val, Leu, or Gly
  SITE (372)..(372): Xaa at position 372 is Val, Ala, Gly, Leu, or Ile
  SITE (375)..(375): Xaa at position 375 is Ile, Ala, Val, Leu, or Gly
  SITE (392)..(392): Xaa at position 392 is Ile, Ala, Val, Leu, or Gly
  SITE (394)..(394): Xaa at position 394 is Val, Ala, Gly, Leu, or Ile
  SITE (402)..(402): Xaa at position 402 is Val, Ala, Gly, Leu, or Ile
  SITE (403)..(403): Xaa at position 403 is Val, Ala, Gly, Leu, or Ile
  SITE (406)..(406): Xaa at position 406 is Leu, Ala, Val, Gly, or Ile
  SITE (415)..(415): Xaa at position 415 is Leu, Ala, Val, Gly, or Ile
  SITE (420)..(420): Xaa at position 420 is Val, Ala, Gly, Leu, or Ile
  SITE (421)..(421): Xaa at position 421 is Val, Ala, Gly, Leu, or Ile
  SITE (422)..(422): Xaa at position 422 is Val, Ala, Gly, Leu, or Ile
  SITE (423)..(423): Xaa at position 423 is Leu, Ala, Val, Gly, or Ile
  SITE (440)..(440): Xaa at position 440 is Leu, Ala, Val, Gly, or Ile
  SITE (441)..(441): Xaa at position 441 is Leu, Ala, Val, Gly, or Ile
  SITE (442)..(442): Xaa at position 442 is Cys, Ala, Val, Gly, Ser, or Thr
  SITE (443)..(443): Xaa at position 443 is Ala, Gly, or Pro
  SITE (455)..(455): Xaa at position 455 is Leu, Ala, Val, Gly, or Ile
  SITE (469)..(469): Xaa at position 469 is Val, Ala, Gly, Leu, or Ile
  SITE (491)..(491): Xaa at position 491 is Leu, Ala, Val, Gly, or Ile
  SITE (495)..(495): Xaa at position 495 is Phe, Tyr, Met, His, Ile, Leu, Val Ala, or Gly
  SITE (497)..(497): Xaa at position 497 is Ile, Ala, Val, Leu, or Gly
  SITE (503)..(503): Xaa at position 503 is Ala, Gly, or Pro
  SITE (510)..(510): Xaa at position 510 is Phe, Tyr, Met, His, Ile, Leu, Val Ala, or Gly
  SITE (517)..(517): Xaa at position 517 is Ile, Ala, Val, Leu, or Gly
  SITE (519)..(519): Xaa at position 519 is Cys, Ala, Val, Gly, Ser, or Thr
  SITE (527)..(527): Xaa at position 527 is Ile, Ala, Val, Leu, or Gly
MGDAPSPEEKLHLXTRNLQEVLGEEKXKEILKEREXKXXWGTATTGKPHVAYXVPXSKXADXLKAGXEXTXLXADLXXYLDNMKXPWELLELRXSXXENXXKAXXESIGVPLEKLKFIKGTDYQLSKEXTLDVYRXSSVVTQHDSKKAGAEVVKQVEHPLLSGLLYPGLQXXDEEYLKVDXQXGGIDQRKXXTFXEKYXPALGYSKRXXXXNPMVPGLTGSKMSSSEEESKXDXLDRKEDXKKKXKKAFCEPGNVENNGXXSFXKHXLFPLKSEFVXLRDEKWGGNKTXTAYVDXEKDXAAEVXHPGDXKNSXEVAXNKLXDPXREKFNTPALKKXASXXYPDPSKQKPMAKGPAKNSEPEEVIPSRLDXRXGKXITVEKHPDADSLYVEKXDXGEAEPRTXXSGXVQFVPKEEXQDRLXXXXCNLKPQKMRGVESQGMXXXXSIEGINRQVEPXDPPAGSAPGEHVFXKGYEKGQPDEELKPKKKVFEKXQADXKXSEECIXQWKQTNXMTKLGSXSXKSLKGGNXS

SEQ ID NO: 569 - protein, 986 aa, Homo sapiens
  SITE (67)..(67): Xaa at position 67 is Ile, Ala, Val, Leu, or Gly
  SITE (72)..(72): Xaa at position 72 is Val, Ala, Gly, Leu, or Ile
  SITE (84)..(84): Xaa at position 84 is Leu, Ala, Val, Gly, or Ile
  SITE (89)..(89): Xaa at position 89 is Ile, Ala, Val, Leu, or Gly
  SITE (94)..(94): Xaa at position 94 is Ala, Gly, or Pro
  SITE (97)..(97): Xaa at position 97 is Val, Ala, Gly, Leu, or Ile
  SITE (98)..(98): Xaa at position 98 is Tyr, Phe, Met, His, Ile, Leu, Val Ala, or Gly
  SITE (99)..(99): Xaa at position 99 is Ile, Ala, Val, Leu, or Gly
  SITE (101)..(101): Xaa at position 101 is Ile, Ala, Val, Leu, or Gly
  SITE (103)..(103): Xaa at position 103 is Phe, Tyr, Met, His, Ile, Leu, Val Ala, or Gly
  SITE (105)..(105): Xaa at position 105 is Leu, Ala, Val, Gly, or Ile
  SITE (114)..(114): Xaa at position 114 is Val, Ala, Gly, Leu, or Ile
  SITE (122)..(122): Xaa at position 122 is Phe, Tyr, Met, His, Ile, Leu, Val Ala, or Gly
  SITE (124)..(124): Xaa at position 124 is Leu, Ala, Val, Gly, or Ile
  SITE (148)..(148): Xaa at position 148 is Ile, Ala, Val, Leu, or Gly
  SITE (157)..(157): Xaa at position 157 is Val, Ala, Gly, Leu, or Ile
  SITE (173)..(173): Xaa at position 173 is Val, Ala, Gly, Leu, or Ile
  SITE (181)..(181): Xaa at position 181 is Phe, Tyr, Met, His, Ile, Leu, Val Ala, or Gly
  SITE (182)..(182): Xaa at position 182 is Tyr, Phe, Met, His, Ile, Leu, Val Ala, or Gly
  SITE (183)..(183): Xaa at position 183 is Leu, Ala, Val, Gly, or Ile
  SITE (184)..(184): Xaa at position 184 is Ala, Gly, or Pro
  SITE (185)..(185): Xaa at position 185 is Phe, Tyr, Met, His, Ile, Leu, Val Ala, or Gly
  SITE (190)..(190): Xaa at position 190 is Ala, Gly, or Pro
  SITE (192)..(192): Xaa at position 192 is Ile, Ala, Val, Leu, or Gly
  SITE (193)..(193): Xaa at position 193 is Ala, Gly, or Pro
  SITE (194)..(194): Xaa at position 194 is Leu, Ala, Val, Gly, or Ile
  SITE (195)..(195): Xaa at position 195 is Val, Ala, Gly, Leu, or Ile
  SITE (197)..(197): Xaa at position 197 is Val, Ala, Gly, Leu, or Ile
  SITE (199)..(199): Xaa at position 199 is Val, Ala, Gly, Leu, or Ile
  SITE (204)..(204): Xaa at position 204 is Cys, Ala, Val, Gly, Ser, or Thr
  SITE (212)..(212): Xaa at position 212 is Ala, Gly, or Pro
  SITE (214)..(214): Xaa at position 214 is Phe, Tyr, Met, His, Ile, Leu, Val Ala, or Gly
  SITE (245)..(245): Xaa at position 245 is Met, Ile, Leu, Val, Ala, or Gly
  SITE (247)..(247): Xaa at position 247 is Cys, Ala, Val, Gly, Ser, or Thr
  SITE (273)..(273): Xaa at position 273 is Cys, Ala, Val, Gly, Ser, or Thr
  SITE (276)..(276): Xaa at position 276 is Cys, Ala, Val, Gly, Ser, or Thr
  SITE (325)..(325): Xaa at position 325 is Cys, Ala, Val, Gly, Ser, or Thr
  SITE (344)..(344): Xaa at position 344 is Val, Ala, Gly, Leu, or Ile
  SITE (346)..(346): Xaa at position 346 is Leu, Ala, Val, Gly, or Ile
  SITE (398)..(398): Xaa at position 398 is Val, Ala, Gly, Leu, or Ile
  SITE (400)..(400): Xaa at position 400 is Ile, Ala, Val, Leu, or Gly
  SITE (409)..(409): Xaa at position 409 is Tyr, Phe, Met, His, Ile, Leu, Val Ala, or Gly
  SITE (411)..(411): Xaa at position 411 is Phe, Tyr, Met, His, Ile, Leu, Val Ala, or Gly
  SITE (413)..(413): Xaa at position 413 is Ile, Ala, Val, Leu, or Gly
  SITE (415)..(415): Xaa at position 415 is Ala, Gly, or Pro
  SITE (419)..(419): Xaa at position 419 is Val, Ala, Gly, Leu, or Ile
  SITE (434)..(434): Xaa at position 434 is Val, Ala, Gly, Leu, or Ile
  SITE (440)..(440): Xaa at position 440 is Ala, Gly, or Pro
  SITE (447)..(447): Xaa at position 447 is Val, Ala, Gly, Leu, or Ile
  SITE (457)..(457): Xaa at position 457 is Val, Ala, Gly, Leu, or Ile
  SITE (459)..(459): Xaa at position 459 is Leu, Ala, Val, Gly, or Ile
  SITE (476)..(476): Xaa at position 476 is Val, Ala, Gly, Leu, or Ile
  SITE (500)..(500): Xaa at position 500 is Ile, Ala, Val, Leu, or Gly
  SITE (509)..(509): Xaa at position 509 is Tyr, Phe, Met, His, Ile, Leu, Val Ala, or Gly
  SITE (511)..(511): Xaa at position 511 is Phe, Tyr, Met, His, Ile, Leu, Val Ala, or Gly
  SITE (513)..(513): Xaa at position 513 is Val, Ala, Gly, Leu, or Ile
  SITE (515)..(515): Xaa at position 515 is Ala, Gly, or Pro
  SITE (519)..(519): Xaa at position 519 is Ala, Gly, or Pro
MAGIFYFALFSCLFGICDAVTGSRVYPANEVTLLDSRSVQGELGWIASPLEGGWEEVSIMDEKNTPXRTYQXCNVMEPSQNNWXRTDWXTREGXQRXXXEXKXTXRDCNSLPGXMGTCKETXNXYYYESDNDKERFIRENQFVKIDTXAADESFTQXDIGDRIMKLNTEIRDXGPLSKKGXXXXXQDVGXCXXXXSXRXFYKKXPLTVRNLXQXPDTITGADTSSLVEVRGSCVNNSEEKDVPKXYXGADGEWLVPIGNCLCNAGHEERSGEXQAXKIGYYKALSTDATCAKCPPHSYSVWEGATSCTCDRGFFRADNDAASMPXTRPPSAPLNLISNVNETSXNXEWSSPQNTGGRQDISYNVVCKKCGAGDPSKCRPCGSGVHYTPQQNGLKTTKXSXTDLLAHTNXTXEXWXVNGXSKYNPNPDQSVSVTXTTNQAXPSSIALXQAKEVTRYSXAXAWLEPDRPNGVILEYEXKYYEKDQNERSYRIVRTAARNTDXKGLNPLTSXVXHXRXRTAXGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQEDLARIGITAITHQNKILSSVQAMRTQMQQMHGRMVPV

SEQ ID NO: 570 - protein, 743 aa, Homo sapiens
  SITE (32)..(32): Xaa at position 32 is Val, Ala, Gly, Leu, or Ile
  SITE (35)..(35): Xaa at position 35 is Leu, Ala, Val, Gly, or Ile
  SITE (36)..(36): Xaa at position 36 is Val, Ala, Gly, Leu, or Ile
  SITE (67)..(67): Xaa at position 67 is Leu, Ala, Val, Gly, or Ile
  SITE (75)..(75): Xaa at position 75 is Val, Ala, Gly, Leu, or Ile
  SITE (77)..(77): Xaa at position 77 is Val, Ala, Gly, Leu, or Ile
  SITE (83)..(83): Xaa at position 83 is Val, Ala, Gly, Leu, or Ile
  SITE (84)..(84): Xaa at position 84 is Ala, Gly, or Pro
  SITE (85)..(85): Xaa at position 85 is Ala, Gly, or Pro
  SITE (86)..(86): Xaa at position 86 is Ala, Gly, or Pro
  SITE (89)..(89): Xaa at position 89 is Leu, Ala, Val, Gly, or Ile
  SITE (92)..(92): Xaa at position 92 is Tyr, Phe, Met, His, Ile, Leu, Val Ala, or Gly
  SITE (99)..(99): Xaa at position 99 is Cys, Ala, Val, Gly, Ser, or Thr
  SITE (132)..(132): Xaa at position 132 is Tyr, Phe, Met, His, Ile, Leu, Val Ala, or Gly
  SITE (154)..(154): Xaa at position 154 is Ile, Ala, Val, Leu, or Gly
  SITE (157)..(157): Xaa at position 157 is Met, Ile, Leu, Val, Ala, or Gly
  SITE (158)..(158): Xaa at position 158 is Ala, Gly, or Pro
  SITE (162)..(162): Xaa at position 162 is Ile, Ala, Val, Leu, or Gly
  SITE (164)..(164): Xaa at position 164 is Leu, Ala, Val, Gly, or Ile
  SITE (165)..(165): Xaa at position 165 is Ala, Gly, or Pro
  SITE (167)..(167): Xaa at position 167 is Ala, Gly, or Pro
  SITE (174)..(174): Xaa at position 174 is Ile, Ala, Val, Leu, or Gly
  SITE (178)..(178): Xaa at position 178 is Val, Ala, Gly, Leu, or Ile
  SITE (181)..(181): Xaa at position 181 is Ala, Gly, or Pro
  SITE (189)..(189): Xaa at position 189 is Ile, Ala, Val, Leu, or Gly
  SITE (197)..(197): Xaa at position 197 is Ala, Gly, or Pro
  SITE (198)..(198): Xaa at position 198 is Phe, Tyr, Met, His, Ile, Leu, Val Ala, or Gly
  SITE (200)..(200): Xaa at position 200 is Ala, Gly, or Pro
  SITE (230)..(230): Xaa at position 230 is Leu, Ala, Val, Gly, or Ile
  SITE (233)..(233): Xaa at position 233 is Met, Ile, Leu, Val, Ala, or Gly
  SITE (236)..(236): Xaa at position 236 is Phe, Tyr, Met, His, Ile, Leu, Val Ala, or Gly
  SITE (241)..(241): Xaa at position 241 is Val, Ala, Gly, Leu, or Ile
  SITE (242)..(242): Xaa at position 242 is Leu, Ala, Val, Gly, or Ile
  SITE (245)..(245): Xaa at position 245 is Phe, Tyr, Met, His, Ile, Leu, Val Ala, or Gly
  SITE (253)..(253): Xaa at position 253 is Val, Ala, Gly, Leu, or Ile
  SITE (271)..(271): Xaa at position 271 is Phe, Tyr, Met, His, Ile, Leu, Val Ala, or Gly
  SITE (281)..(281): Xaa at position 281 is Leu, Ala, Val, Gly, or Ile
  SITE (291)..(291): Xaa at position 291 is Ile, Ala, Val, Leu, or Gly
  SITE (295)..(295): Xaa at position 295 is Phe, Tyr, Met, His, Ile, Leu, Val Ala, or Gly
  SITE (296)..(296): Xaa at position 296 is Leu, Ala, Val, Gly, or Ile
  SITE (309)..(309): Xaa at position 309 is Tyr, Phe, Met, His, Ile, Leu, Val Ala, or Gly
  SITE (327)..(327): Xaa at position 327 is Leu, Ala, Val, Gly, or Ile
  SITE (334)..(334): Xaa at position 334 is Val, Ala, Gly, Leu, or Ile
  SITE (338)..(338): Xaa at position 338 is Met, Ile, Leu, Val, Ala, or Gly
  SITE (345)..(345): Xaa at position 345 is Ala, Gly, or Pro
  SITE (354)..(354): Xaa at position 354 is Phe, Tyr, Met, His, Ile, Leu, Val Ala, or Gly
  SITE (368)..(368): Xaa at position 368 is Ala, Gly, or Pro
  SITE (378)..(378): Xaa at position 378 is Leu, Ala, Val, Gly, or Ile
  SITE (379)..(379): Xaa at position 379 is Leu, Ala, Val, Gly, or Ile
  SITE (380)..(380): Xaa at position 380 is Val, Ala, Gly, Leu, or Ile
  SITE (390)..(390): Xaa at position 390 is Val, Ala, Gly, Leu, or Ile
  SITE (397)..(397): Xaa at position 397 is Phe, Tyr, Met, His, Ile, Leu, Val Ala, or Gly
  SITE (402)..(402): Xaa at position 402 is Phe, Tyr, Met, His, Ile, Leu, Val Ala, or Gly
  SITE (403)..(403): Xaa at position 403 is Ile, Ala, Val, Leu, or Gly
  SITE (404)..(404): Xaa at position 404 is Trp, Tyr, Phe, Met, His, Ile, Leu Val, Ala, or Gly
  SITE (405)..(405): Xaa at position 405 is Cys, Ala, Val, Gly, Ser, or Thr
  SITE (406)..(406): Xaa at position 406 is Met, Ile, Leu, Val, Ala, or Gly
  SITE (407)..(407): Xaa at position 407 is Leu, Ala, Val, Gly, or Ile
  SITE (420)..(420): Xaa at position 420 is Leu, Ala, Val, Gly, or Ile
  SITE (430)..(430): Xaa at position 430 is Ala, Gly, or Pro
  SITE (444)..(444): Xaa at position 444 is Ala, Gly, or Pro
  SITE (453)..(453): Xaa at position 453 is Val, Ala, Gly, Leu, or Ile
  SITE (454)..(454): Xaa at position 454 is Val, Ala, Gly, Leu, or Ile
  SITE (457)..(457): Xaa at position 457 is Leu, Ala, Val, Gly, or Ile
  SITE (475)..(475): Xaa at position 475 is Val, Ala, Gly, Leu, or Ile
  SITE (478)..(478): Xaa at position 478 is Phe, Tyr, Met, His, Ile, Leu, Val Ala, or Gly
  SITE (479)..(479): Xaa at position 479 is Ala, Gly, or Pro
  SITE (490)..(490): Xaa at position 490 is Ala, Gly, or Pro
  SITE (493)..(493): Xaa at position 493 is Ala, Gly, or Pro
  SITE (501)..(501): Xaa at position 501 is Val, Ala, Gly, Leu, or Ile
  SITE (517)..(517): Xaa at position 517 is Leu, Ala, Val, Gly, or Ile
  SITE (518)..(518): Xaa at position 518 is Val, Ala, Gly, Leu, or Ile
  SITE (536)..(536): Xaa at position 536 is Val, Ala, Gly, Leu, or Ile
  SITE (537)..(537): Xaa at position 537 is Phe, Tyr, Met, His, Ile, Leu, Val Ala, or Gly
  SITE (539)..(539): Xaa at position 539 is Ala, Gly, or Pro
  SITE (540)..(540): Xaa at position 540 is Trp, Tyr, Phe, Met, His, Ile, Leu Val, Ala, or Gly
  SITE (550)..(550): Xaa at position 550 is Leu, Ala, Val, Gly, or Ile
  SITE (556)..(556): Xaa at position 556 is Phe, Tyr, Met, His, Ile, Leu, Val Ala, or Gly
  SITE (560)..(560): Xaa at position 560 is Leu, Ala, Val, Gly, or Ile
  SITE (561)..(561): Xaa at position 561 is Leu, Ala, Val, Gly, or Ile
  SITE (563)..(563): Xaa at position 563 is Leu, Ala, Val, Gly, or Ile
  SITE (567)..(567): Xaa at position 567 is Ala, Gly, or Pro
  SITE (568)..(568): Xaa at position 568 is Val, Ala, Gly, Leu, or Ile
  SITE (571)..(571): Xaa at position 571 is Leu, Ala, Val, Gly, or Ile
  SITE (572)..(572): Xaa at position 572 is Val, Ala, Gly, Leu, or Ile
  SITE (575)..(575): Xaa at position 575 is Tyr, Phe, Met, His, Ile, Leu, Val Ala, or Gly
  SITE (584)..(584): Xaa at position 584 is Leu, Ala, Val, Gly, or Ile
  SITE (591)..(591): Xaa at position 591 is Leu, Ala, Val, Gly, or Ile
  SITE (597)..(597): Xaa at position 597 is Val, Ala, Gly, Leu, or Ile
  SITE (598)..(598): Xaa at position 598 is Leu, Ala, Val, Gly, or Ile
  SITE (599)..(599): Xaa at position 599 is Ala, Gly, or Pro
  SITE (602)..(602): Xaa at position 602 is Leu, Ala, Val, Gly, or Ile
  SITE (603)..(603): Xaa at position 603 is Leu, Ala, Val, Gly, or Ile
  SITE (606)..(606): Xaa at position 606 is Leu, Ala, Val, Gly, or Ile
  SITE (609)..(609): Xaa at position 609 is Val, Ala, Gly, Leu, or Ile
  SITE (610)..(610): Xaa at position 610 is Leu, Ala, Val, Gly, or Ile
  SITE (616)..(616): Xaa at position 616 is Phe, Tyr, Met, His, Ile, Leu, Val Ala, or Gly
  SITE (618)..(618): Xaa at position 618 is Leu, Ala, Val, Gly, or Ile
  SITE (622)..(622): Xaa at position 622 is Leu, Ala, Val, Gly, or Ile
  SITE (625)..(625): Xaa at position 625 is Ala, Gly, or Pro
  SITE (635)..(635): Xaa at position 635 is Ala, Gly, or Pro
  SITE (638)..(638): Xaa at position 638 is Tyr, Phe, Met, His, Ile, Leu, Val Ala, or Gly
  SITE (646)..(646): Xaa at position 646 is Leu, Ala, Val, Gly, or Ile
  SITE (648)..(648): Xaa at position 648 is Leu, Ala, Val, Gly, or Ile
  SITE (649)..(649): Xaa at position 649 is Trp, Tyr, Phe, Met, His, Ile, Leu Val, Ala, or Gly
  SITE (659)..(659): Xaa at position 659 is Ala, Gly, or Pro
  SITE (666)..(666): Xaa at position 666 is Leu, Ala, Val, Gly, or Ile
  SITE (667)..(667): Xaa at position 667 is Val, Ala, Gly, Leu, or Ile
  SITE (670)..(670): Xaa at position 670 is Tyr, Phe, Met, His, Ile, Leu, Val Ala, or Gly
  SITE (671)..(671): Xaa at position 671 is Tyr, Phe, Met, His, Ile, Leu, Val Ala, or Gly
  SITE (675)..(675): Xaa at position 675 is Trp, Tyr, Phe, Met, His, Ile, Leu Val, Ala, or Gly
  SITE (678)..(678): Xaa at position 678 is Phe, Tyr, Met, His, Ile, Leu, Val Ala, or Gly
  SITE (679)..(679): Xaa at position 679 is Leu, Ala, Val, Gly, or Ile
  SITE (682)..(682): Xaa at position 682 is Leu, Ala, Val, Gly, or Ile
  SITE (701)..(701): Xaa at position 701 is Val, Ala, Gly, Leu, or Ile
  SITE (709)..(709): Xaa at position 709 is Val, Ala, Gly, Leu, or Ile
  SITE (724)..(724): Xaa at position 724 is Val, Ala, Gly, Leu, or Ile
  SITE (727)..(727): Xaa at position 727 is Ala, Gly, or Pro
  SITE (734)..(734): Xaa at position 734 is Tyr, Phe, Met, His, Ile, Leu, Val Ala, or Gly
MEAVAVAAAVGVLLLAGAGGAAGDEAREAAAXRAXXARLLGPGPAADFSVSVERALAAKPGLDTYSXGGGGAARXRXRGSTGXXXXAGXHRXLRDFCGXHVAWSGSQLRLPRPLPAVPGELTEATPNRYRYXQNVCTQSYSFVWWDWARWEREXDWXXLNGXNXXLXWSGQEAXWQRXYLXLGLTQAEXNEFFTGPXXLXWGRMGNLHTWDGPLPPSWHIKQLYLQHRVXDQXRSXGMTPXXPAXAGHVPEAXTRVFPQVNVTKMGSWGHXNCSYSCSFLXAPEDPIFPIXGSLXXRELIKEFGTDHIXGADTFNEMQPPSSEPSYXAAATTAXYEAXTAVDTEXVWLLQGWLXQHQPQFWGPAQIRXVLGAVPRGRXXXLDLFAESQPXYTRTASXQGQPXXXXXXHNFGGNHGLFGAXEAVNGGPEAXRLFPNSTMVGTGMXPEGISQNEXXYSXMAELGWRKDPVPDLAAWXTSXXARRYGVSHPDXGAXWRLLLRSXYNCSGEACRGHNRSPXXRRPSLQMNTSIWYNRSDXXEXXRLLLTSAPSXATSPAXRYDXXDXTRQXXQEXXSLXYEEARSAYXSKELASXLRAGGXXXYEXXPAXDEXXASDSRXLXGSWXEQXRAAAVSEAEXDFXEQNSRYQXTXXGPEGNILDYXNKQLAGXXANXXTPRXRLXXEAXVDSVAQGIPFQQHQFDKNXFQLEQAFXLSKQRYPSQPRGDTXDLXKKIFLKXYPRWVAGSW

SEQ ID NO: 571 - protein, 685 aa, Homo sapiens
  SITE (83)..(83): Xaa at position 83 is Leu, Ala, Val, Gly, or Ile
  SITE (95)..(95): Xaa at position 95 is Leu, Ala, Val, Gly, or Ile
  SITE (98)..(98): Xaa at position 98 is Leu, Ala, Val, Gly, or Ile
  SITE (437)..(437): Xaa at position 437 is Phe, Tyr, Met, His, Ile, Leu, Val Ala, or Gly
  SITE (576)..(576): Xaa at position 576 is Val, Ala, Gly, Leu, or Ile
  SITE (607)..(607): Xaa at position 607 is Val, Ala, Gly, Leu, or Ile
MAEWLLSASWQRRAKAMTAAAGSAGRAAVPLLLCALLAPGGAYVLDDSDGLGREFDGIGAVSGGGATSRLLVNYPEPYRSQIXDYLFKPNFGASXHIXKVEIGGDGQTTDGTEPSHMHYALDENYFRGYEWWLMKEAKKRNPNITLIGLPWSFPGWLGKGFDWPYVNLQLTAYYVVTWIVGAKRYHDLDIDYIGIWNERSYNANYIKILRKMLNYQGLQRVKIIASDNLWESISASMLLDAELFKVVDVIGAHYPGTHSAKDAKLTGKKLWSSEDFSTLNSDMGAGCWGRILNQNYINGYMTSTIAWNLVASYYEQLPYGRCGLMTAQEPWSGHYVVESPVWVSAHTTQFTQPGWYYLKTVGHLEKGGSYVALTDGLGNLTIIIETMSHKHSKCIRPFLPYFNVSQQFATFVLKGSFSEIPELQVWYTKLGKTSERXLFKQLDSLWLLDSDGSFTLSLHEDELFTLTTLTTGRKGSYPLPPKSQPFPSTYKDDFNVDYPFFSEAPNFADQTGVFEYFTNIEDPGEHHFTLRQVLNQRPITWAADASNTISIIGDYNWTNLTIKCDVYIETPDTGGXFIAGRVNKGGILIRSARGIFFWIFANGSYRXTGDLAGWIIYALGRVEVTAKKWYTLTLTIKGHFTSGMLNDKSLWTDIPVNFPKNGWAAIGTHSFEFAQFDNFLVEATR

SEQ ID NO: 572 - protein, 239 aa, Homo sapiens
  SITE (16)..(16): Xaa at position 16 is Ile, Ala, Val, Leu, or Gly
  SITE (18)..(18): Xaa at position 18 is Ala, Gly, or Pro
  SITE (19)..(19): Xaa at position 19 is Val, Ala, Gly, Leu, or Ile
  SITE (20)..(20): Xaa at position 20 is Leu, Ala, Val, Gly, or Ile
  SITE (21)..(21): Xaa at position 21 is Leu, Ala, Val, Gly, or Ile
  SITE (26)..(26): Xaa at position 26 is Ala, Gly, or Pro
  SITE (32)..(32): Xaa at position 32 is Ala, Gly, or Pro
  SITE (35)..(35): Xaa at position 35 is Leu, Ala, Val, Gly, or Ile
  SITE (39)..(39): Xaa at position 39 is Phe, Tyr, Met, His, Ile, Leu, Val Ala, or Gly
  SITE (41)..(41): Xaa at position 41 is Val, Ala, Gly, Leu, or Ile
  SITE (64)..(64): Xaa at position 64 is Leu, Ala, Val, Gly, or Ile
  SITE (80)..(80): Xaa at position 80 is Val, Ala, Gly, Leu, or Ile
  SITE (82)..(82): Xaa at position 82 is Leu, Ala, Val, Gly, or Ile
  SITE (83)..(83): Xaa at position 83 is Ile, Ala, Val, Leu, or Gly
  SITE (96)..(96): Xaa at position 96 is Phe, Tyr, Met, His, Ile, Leu, Val Ala, or Gly
  SITE (97)..(97): Xaa at position 97 is Leu, Ala, Val, Gly, or Ile
  SITE (98)..(98): Xaa at position 98 is Leu, Ala, Val, Gly, or Ile
  SITE (101)..(101): Xaa at position 101 is Phe, Tyr, Met, His, Ile, Leu, Val Ala, or Gly
  SITE (108)..(108): Xaa at position 108 is Ala, Gly, or Pro
  SITE (111)..(111): Xaa at position 111 is Leu, Ala, Val, Gly, or Ile
  SITE (115)..(115): Xaa at position 115 is Met, Ile, Leu, Val, Ala, or Gly
  SITE (122)..(122): Xaa at position 122 is Leu, Ala, Val, Gly, or Ile
  SITE (125)..(125): Xaa at position 125 is Val, Ala, Gly, Leu, or Ile
  SITE (126)..(126): Xaa at position 126 is Ile, Ala, Val, Leu, or Gly
  SITE (128)..(128): Xaa at position 128 is Phe, Tyr, Met, His, Ile, Leu, Val Ala, or Gly
  SITE (134)..(134): Xaa at position 134 is Leu, Ala, Val, Gly, or Ile
  SITE (135)..(135): Xaa at position 135 is Leu, Ala, Val, Gly, or Ile
  SITE (139)..(139): Xaa at position 139 is Ile, Ala, Val, Leu, or Gly
  SITE (143)..(143): Xaa at position 143 is Leu, Ala, Val, Gly, or Ile
  SITE (145)..(145): Xaa at position 145 is His, Phe, Tyr, Lys, Arg, Gly, Ser Thr, Ala, Val, Leu, Ile, Asn, Met, or Gln
  SITE (182)..(182): Xaa at position 182 is Ala, Gly, or Pro
  SITE (183)..(183): Xaa at position 183 is Leu, Ala, Val, Gly, or Ile
  SITE (187)..(187): Xaa at position 187 is Leu, Ala, Val, Gly, or Ile
  SITE (197)..(197): Xaa at position 197 is Leu, Ala, Val, Gly, or Ile
  SITE (200)..(200): Xaa at position 200 is Tyr, Phe, Met, His, Ile, Leu, Val Ala, or Gly
  SITE (201)..(201): Xaa at position 201 is Tyr, Phe, Met, His, Ile, Leu, Val Ala, or Gly
  SITE (210)..(210): Xaa at position 210 is Ile, Ala, Val, Leu, or Gly
  SITE (212)..(212): Xaa at position 212 is Ala, Gly, or Pro
  SITE (223)..(223): Xaa at position 223 is Ile, Ala, Val, Leu, or Gly
  SITE (227)..(227): Xaa at position 227 is Phe, Tyr, Met, His, Ile, Leu, Val Ala, or Gly
MAPSVPAAEPEYPKGXRXXXXGPPGXGKGTQXPRXAENXCXCHLATGDMLRAMVASGSELGKKXKATMDAGKLVSDEMVXEXXEKNLETPLCKNGXXXDGXPRTVRQXEMXDDLXEKRKEKXDSXXEXSIPDSXXIRRXTGRXIXPKSGRSYHEEFNPPKEPMKDDITGEPLIRRSDDNEKXXKIRXQAYHTQTTPXIEXXRKRGIHSAXDXSQTPDVVFASXLAAXSKATCKDLVMFI

SEQ ID NO: 573 - protein, 147 aa, Homo sapiens
  SITE (24)..(24): Xaa at position 24 is Leu, Ala, Val, Gly, or Ile
  SITE (47)..(47): Xaa at position 47 is Leu, Ala, Val, Gly, or Ile
  SITE (50)..(50): Xaa at position 50 is Phe, Tyr, Met, His, Ile, Leu, Val Ala, or Gly
  SITE (54)..(54): Xaa at position 54 is Tyr, Phe, Met, His, Ile, Leu, Val Ala, or Gly
  SITE (57)..(57): Xaa at position 57 is Phe, Tyr, Met, His, Ile, Leu, Val Ala, or Gly
  SITE (59)..(59): Xaa at position 59 is Leu, Ala, Val, Gly, or Ile
  SITE (65)..(65): Xaa at position 65 is Ile, Ala, Val, Leu, or Gly
  SITE (70)..(70): Xaa at position 70 is Leu, Ala, Val, Gly, or Ile
  SITE (73)..(73): Xaa at position 73 is Met, Ile, Leu, Val, Ala, or Gly
  SITE (74)..(74): Xaa at position 74 is Leu, Ala, Val, Gly, or Ile
  SITE (86)..(86): Xaa at position 86 is Leu, Ala, Val, Gly, or Ile
  SITE (90)..(90): Xaa at position 90 is Ile, Ala, Val, Leu, or Gly
  SITE (101)..(101): Xaa at position 101 is Phe, Tyr, Met, His, Ile, Leu, Val Ala, or Gly
  SITE (103)..(103): Xaa at position 103 is Tyr, Phe, Met, His, Ile, Leu, Val Ala, or Gly
  SITE (106)..(106): Xaa at position 106 is Phe, Tyr, Met, His, Ile, Leu, Val Ala, or Gly
  SITE (107)..(107): Xaa at position 107 is Leu, Ala, Val, Gly, or Ile
  SITE (116)..(116): Xaa at position 116 is Ala, Gly, or Pro
  SITE (118)..(118): Xaa at position 118 is Leu, Ala, Val, Gly, or Ile
MSQTRDLQGGKAFGLLKAQQEERXDEINKQFLDDPKYSSDEDLPSKXEGXKEKXMEXDXNGNGDXDIMSXKRXXEKLGVPKTHLEXKKLXGEVSSGSGETXSXPDXXRMMLGKRSXIXKMILMYEEKAREKEKPTGPPAKKAISELP

SEQ ID NO: 574 - protein, 806 aa, Homo sapiens
  SITE (26)..(26): Xaa at position 26 is Leu, Ala, Val, Gly, or Ile
  SITE (28)..(28): Xaa at position 28 is Val, Ala, Gly, Leu, or Ile
  SITE (38)..(38): Xaa at position 38 is Val, Ala, Gly, Leu, or Ile
  SITE (39)..(39): Xaa at position 39 is Val, Ala, Gly, Leu, or Ile
  SITE (41)..(41): Xaa at position 41 is Leu, Ala, Val, Gly, or Ile
  SITE (46)..(46): Xaa at position 46 is Met, Ile, Leu, Val, Ala, or Gly
  SITE (57)..(57): Xaa at position 57 is Val, Ala, Gly, Leu, or Ile
  SITE (59)..(59): Xaa at position 59 is Leu, Ala, Val, Gly, or Ile
  SITE (67)..(67): Xaa at position 67 is Ala, Gly, or Pro
  SITE (68)..(68): Xaa at position 68 is Val, Ala, Gly, Leu, or Ile
  SITE (69)..(69): Xaa at position 69 is Cys, Ala, Val, Gly, Ser, or Thr
  SITE (71)..(71): Xaa at position 71 is Val, Ala, Gly, Leu, or Ile
  SITE (82)..(82): Xaa at position 82 is Ile, Ala, Val, Leu, or Gly
  SITE (84)..(84): Xaa at position 84 is Met, Ile, Leu, Val, Ala, or Gly
  SITE (88)..(88): Xaa at position 88 is Val, Ala, Gly, Leu, or Ile
  SITE (92)..(92): Xaa at position 92 is Leu, Ala, Val, Gly, or Ile
  SITE (94)..(94): Xaa at position 94 is Val, Ala, Gly, Leu, or Ile
  SITE (100)..(100): Xaa at position 100 is Ile, Ala, Val, Leu, or Gly
  SITE (102)..(102): Xaa at position 102 is Ile, Ala, Val, Leu, or Gly
  SITE (105)..(105): Xaa at position 105 is Cys, Ala, Val, Gly, Ser, or Thr
  SITE (114)..(114): Xaa at position 114 is Ile, Ala, Val, Leu, or Gly
  SITE (116)..(116): Xaa at position 116 is Val, Ala, Gly, Leu, or Ile
  SITE (119)..(119): Xaa at position 119 is Ile, Ala, Val, Leu, or Gly
  SITE (134)..(134): Xaa at position 134 is Tyr, Phe, Met, His, Ile, Leu, Val Ala, or Gly
  SITE (135)..(135): Xaa at position 135 is Leu, Ala, Val, Gly, or Ile
  SITE (139)..(139): Xaa at position 139 is Phe, Tyr, Met, His, Ile, Leu, Val Ala, or Gly
  SITE (153)..(153): Xaa at position 153 is Leu, Ala, Val, Gly, or Ile
  SITE (154)..(154): Xaa at position 154 is Val, Ala, Gly, Leu, or Ile
  SITE (161)..(161): Xaa at position 161 is Val, Ala, Gly, Leu, or Ile
  SITE (163)..(163): Xaa at position 163 is Phe, Tyr, Met, His, Ile, Leu, Val Ala, or Gly
  SITE (165)..(165): Xaa at position 165 is Val, Ala, Gly, Leu, or Ile
  SITE (166)..(166): Xaa at position 166 is Val, Ala, Gly, Leu, or Ile
  SITE (174)..(174): Xaa at position 174 is Cys, Ala, Val, Gly, Ser, or Thr
  SITE (176)..(176): Xaa at position 176 is Val, Ala, Gly, Leu, or Ile
  SITE (177)..(177): Xaa at position 177 is Ala, Gly, or Pro
  SITE (181)..(181): Xaa at position 181 is Val, Ala, Gly, Leu, or Ile
  SITE (184)..(184): Xaa at position 184 is Cys, Ala, Val, Gly, Ser, or Thr
  SITE (214)..(214): Xaa at position 214 is Ala, Gly, or Pro
  SITE (216)..(216): Xaa at position 216 is Ile, Ala, Val, Leu, or Gly
  SITE (220)..(220): Xaa at position 220 is Val, Ala, Gly, Leu, or Ile
  SITE (241)..(241): Xaa at position 241 is Ile, Ala, Val, Leu, or Gly
  SITE (242)..(242): Xaa at position 242 is Leu, Ala, Val, Gly, or Ile
  SITE (243)..(243): Xaa at position 243 is Leu, Ala, Val, Gly, or Ile
  SITE (244)..(244): Xaa at position 244 is Tyr, Phe, Met, His, Ile, Leu, Val Ala, or Gly
  SITE (254)..(254): Xaa at position 254 is Ile, Ala, Val, Leu, or Gly
  SITE (255)..(255): Xaa at position 255 is Ala, Gly, or Pro
  SITE (257)..(257): Xaa at position 257 is Ala, Gly, or Pro
  SITE (258)..(258): Xaa at position 258 is Val, Ala, Gly, Leu, or Ile
  SITE (259)..(259): Xaa at position 259 is Ala, Gly, or Pro
  SITE (269)..(269): Xaa at position 269 is Ile, Ala, Val, Leu, or Gly
  SITE (274)..(274): Xaa at position 274 is Ile, Ala, Val, Leu, or Gly
  SITE (286)..(286): Xaa at position 286 is Leu, Ala, Val, Gly, or Ile
  SITE (289)..(289): Xaa at position 289 is Ala, Gly, or Pro
  SITE (290)..(290): Xaa at position 290 is Phe, Tyr, Met, His, Ile, Leu, Val Ala, or Gly
  SITE (293)..(293): Xaa at position 293 is Ala, Gly, or Pro
  SITE (299)..(299): Xaa at position 299 is Ala, Gly, or Pro
  SITE (300)..(300): Xaa at position 300 is Ile, Ala, Val, Leu, or Gly
  SITE (301)..(301): Xaa at position 301 is Ile, Ala, Val, Leu, or Gly
  SITE (302)..(302): Xaa at position 302 is Phe, Tyr, Met, His, Ile, Leu, Val Ala, or Gly
  SITE (303)..(303): Xaa at position 303 is Ile, Ala, Val, Leu, or Gly
  SITE (306)..(306): Xaa at position 306 is Leu, Ala, Val, Gly, or Ile
  SITE (309)..(309): Xaa at position 309 is Ile, Ala, Val, Leu, or Gly
  SITE (310)..(310): Xaa at position 310 is Ala, Gly, or Pro
  SITE (324)..(324): Xaa at position 324 is Ile, Ala, Val, Leu, or Gly
  SITE (325)..(325): Xaa at position 325 is Val, Ala, Gly, Leu, or Ile
  SITE (328)..(328): Xaa at position 328 is Leu, Ala, Val, Gly, or Ile
  SITE (329)..(329): Xaa at position 329 is Leu, Ala, Val, Gly, or Ile
  SITE (332)..(332): Xaa at position 332 is Met, Ile, Leu, Val, Ala, or Gly
  SITE (335)..(335): Xaa at position 335 is Leu, Ala, Val, Gly, or Ile
  SITE (341)..(341): Xaa at position 341 is Val, Ala, Gly, Leu, or Ile
  SITE (342)..(342): Xaa at position 342 is Ile, Ala, Val, Leu, or Gly
  SITE (343)..(343): Xaa at position 343 is Val, Ala, Gly, Leu, or Ile
  SITE (344)..(344): Xaa at position 344 is Met, Ile, Leu, Val, Ala, or Gly
  SITE (345)..(345): Xaa at position 345 is Ala, Gly, or Pro
  SITE (346)..(346): Xaa at position 346 is Ala, Gly, or Pro
  SITE (353)..(353): Xaa at position 353 is Ile, Ala, Val, Leu, or Gly
  SITE (357)..(357): Xaa at position 357 is Leu, Ala, Val, Gly, or Ile
  SITE (363)..(363): Xaa at position 363 is Phe, Tyr, Met, His, Ile, Leu, Val Ala, or Gly
  SITE (367)..(367): Xaa at position 367 is Val, Ala, Gly, Leu, or Ile
  SITE (369)..(369): Xaa at position 369 is Ile, Ala, Val, Leu, or Gly
  SITE (381)..(381): Xaa at position 381 is Leu, Ala, Val, Gly, or Ile
  SITE (399)..(399): Xaa at position 399 is Val, Ala, Gly, Leu, or Ile
  SITE (400)..(400): Xaa at position 400 is Ala, Gly, or Pro
  SITE (406)..(406): Xaa at position 406 is His, Phe, Tyr, Lys, Arg, Gly, Ser Thr, Ala, Val, Leu, Ile, Asn, Met, or Gln
  SITE (407)..(407): Xaa at position 407 is Val, Ala, Gly, Leu, or Ile
  SITE (411)..(411): Xaa at position 411 is Leu, Ala, Val, Gly, or Ile
  SITE (414)..(414): Xaa at position 414 is Leu, Ala, Val, Gly, or Ile
  SITE (415)..(415): Xaa at position 415 is Cys, Ala, Val, Gly, Ser, or Thr
  SITE (418)..(418): Xaa at position 418 is Ala, Gly, or Pro
  SITE (419)..(419): Xaa at position 419 is Ala, Gly, or Pro
  SITE (422)..(422): Xaa at position 422 is Ala, Gly, or Pro
  SITE (439)..(439): Xaa at position 439 is Ala, Gly, or Pro
  SITE (447)..(447): Xaa at position 447 is Val, Ala, Gly, Leu, or Ile
  SITE (452)..(452): Xaa at position 452 is Phe, Tyr, Met, His, Ile, Leu, Val Ala, or Gly
  SITE (455)..(455): Xaa at position 455 is Ala, Gly, or Pro
  SITE (489)..(489): Xaa at position 489 is Leu, Ala, Val, Gly, or Ile
  SITE (493)..(493): Xaa at position 493 is Val, Ala, Gly, Leu, or Ile
  SITE (514)..(514): Xaa at position 514 is Val, Ala, Gly, Leu, or Ile
  SITE (515)..(515): Xaa at position 515 is Leu, Ala, Val, Gly, or Ile
  SITE (516)..(516): Xaa at position 516 is Phe, Tyr, Met, His, Ile, Leu, Val Ala, or Gly
  SITE (527)..(527): Xaa at position 527 is Leu, Ala, Val, Gly, or Ile
  SITE (528)..(528): Xaa at position 528 is Ala, Gly, or Pro
  SITE (530)..(530): Xaa at position 530 is Ala, Gly, or Pro
  SITE (531)..(531): Xaa at position 531 is Ile, Ala, Val, Leu, or Gly
  SITE (532)..(532): Xaa at position 532 is Ala, Gly, or Pro
  SITE (539)..(539): Xaa at position 539 is Phe, Tyr, Met, His, Ile, Leu, Val Ala, or Gly
  SITE (540)..(540): Xaa at position 540 is Ile, Ala, Val, Leu, or Gly
  SITE (542)..(542): Xaa at position 542 is Ile, Ala, Val, Leu, or Gly
  SITE (547)..(547): Xaa at position 547 is Leu, Ala, Val, Gly, or Ile
  SITE (548)..(548): Xaa at position 548 is Leu, Ala, Val, Gly, or Ile
  SITE (559)..(559): Xaa at position 559 is Val, Ala, Gly, Leu, or Ile
  SITE (563)..(563): Xaa at position 563 is Phe, Tyr, Met, His, Ile, Leu, Val Ala, or Gly
  SITE (566)..(566): Xaa at position 566 is Ala, Gly, or Pro
  SITE (572)..(572): Xaa at position 572 is Cys, Ala, Val, Gly, Ser, or Thr
  SITE (573)..(573): Xaa at position 573 is Val, Ala, Gly, Leu, or Ile
  SITE (574)..(574): Xaa at position 574 is Leu, Ala, Val, Gly, or Ile
  SITE (575)..(575): Xaa at position 575 is Phe, Tyr, Met, His, Ile, Leu, Val Ala, or Gly
  SITE (576)..(576): Xaa at position 576 is Phe, Tyr, Met, His, Ile, Leu, Val Ala, or Gly
  SITE (582)..(582): Xaa at position 582 is Ile, Ala, Val, Leu, or Gly
  SITE (600)..(600): Xaa at position 600 is Val, Ala, Gly, Leu, or Ile
  SITE (601)..(601): Xaa at position 601 is Ile, Ala, Val, Leu, or Gly
  SITE (608)..(608): Xaa at position 608 is Met, Ile, Leu, Val, Ala, or Gly
  SITE (619)..(619): Xaa at position 619 is Ile, Ala, Val, Leu, or Gly
  SITE (620)..(620): Xaa at position 620 is Ile, Ala, Val, Leu, or Gly
  SITE (622)..(622): Xaa at position 622 is Ala, Gly, or Pro
  SITE (639)..(639): Xaa at position 639 is Leu, Ala, Val, Gly, or Ile
  SITE (645)..(645): Xaa at position 645 is Ile, Ala, Val, Leu, or Gly
  SITE (657)..(657): Xaa at position 657 is Leu, Ala, Val, Gly, or Ile
  SITE (676)..(676): Xaa at position 676 is Ala, Gly, or Pro
  SITE (687)..(687): Xaa at position 687 is Leu, Ala, Val, Gly, or Ile
  SITE (690)..(690): Xaa at position 690 is Ile, Ala, Val, Leu, or Gly
  SITE (694)..(694): Xaa at position 694 is Ala, Gly, or Pro
  SITE (731)..(731): Xaa at position 731 is Ile, Ala, Val, Leu, or Gly
  SITE (735)..(735): Xaa at position 735 is His, Phe, Tyr, Lys, Arg, Gly, Ser Thr, Ala, Val, Leu, Ile, Asn, Met, or Gln
  SITE (739)..(739): Xaa at position 739 is Ala, Gly, or Pro
  SITE (747)..(747): Xaa at position 747 is Val, Ala, Gly, Leu, or Ile
  SITE (752)..(752): Xaa at position 752 is Ile, Ala, Val, Leu, or Gly
  SITE (762)..(762): Xaa at position 762 is Leu, Ala, Val, Gly, or Ile
MASGADSKGDDLSTAILKQKNRPNRXIXDEAINEDNSXXSXSQPKXDELQLFRGDTXLXKGKKRREXXXIXLSDDTCSDEKXRXNRVXRNNXRXRLGDVXSXQPXPDVKYGKRXHXLPXDDTVEGITGNLFEVXXKPYXLEAYRPIRKGDIFXXRGGMRAXEXKXXETDPSPYXIXXPDTXIHXEGEPIKREDEEESLNEVGYDDIGGCRKQLXQXKEMXELPLRHPALFKAIGVKPPRGXXXXGPPGTGKTLXXRXXXNETGAFFFLXNGPEXMSKLAGESESNXRKXXEEXEKNAPXXXXXDEXDAXXPKREKTHGEVERRXXSQXXTLXDGXKQRAHXXXXXXTNRPNSXDPAXRRFGRXDREXDXGIPDATGRLEIXQIHTKNMKLADDVDLEQXXNETHGXXGADXAAXXSEXXLQXIRKKMDLIDLEDETIDXEVMNSLAXTMDDXRWXLSQSNPSALRETVVEVPQVTWEDIGGLEDVKREXQELXQYPVEHPDKFLKFGMTPSKGXXXYGPPGCGKTLXXKXXXNECQANXXSXKGPEXXTMWFGESEANXREIXDKXRQAAPXXXXXDELDSXAKARGGNIGDGGGAADRXXNQILTEXDGMSTKKNVFXXGXTNRPDIIDPAILRPGRXDQLIYXPLPDEKSRVAIXKANLRKSPVAKDVDLEFLXKMTNGFSGADXTEXCQRXCKLAIRESIESEIRRERERQTNPSAMEVEEDDPVPEXRRDXFEEXMRFARRSXSDNDXRKYEMFAQTXQQSRGFGSFRFPSGNQGGAGPSQGSGGGTGGSVYTEDNDDDLYG

SEQ ID NO: 575 - protein, 233 aa, Homo sapiens
  SITE (74)..(74): Xaa at position 74 is Leu, Ala, Val, Gly, or Ile
  SITE (83)..(83): Xaa at position 83 is Val, Ala, Gly, Leu, or Ile
  SITE (85)..(85): Xaa at position 85 is Val, Ala, Gly, Leu, or Ile
  SITE (93)..(93): Xaa at position 93 is Ala, Gly, or Pro
  SITE (95)..(95): Xaa at position 95 is Ala, Gly, or Pro
  SITE (102)..(102): Xaa at position 102 is Ala, Gly, or Pro
  SITE (126)..(126): Xaa at position 126 is Ile, Ala, Val, Leu, or Gly
  SITE (127)..(127): Xaa at position 127 is Cys, Ala, Val, Gly, Ser, or Thr
  SITE (128)..(128): Xaa at position 128 is Met, Ile, Leu, Val, Ala, or Gly
  SITE (135)..(135): Xaa at position 135 is Ile, Ala, Val, Leu, or Gly
  SITE (145)..(145): Xaa at position 145 is Cys, Ala, Val, Gly, Ser, or Thr
  SITE (147)..(147): Xaa at position 147 is Phe, Tyr, Met, His, Ile, Leu, Val Ala, or Gly
  SITE (158)..(158): Xaa at position 158 is Ala, Gly, or Pro
  SITE (169)..(169): Xaa at position 169 is Met, Ile, Leu, Val, Ala, or Gly
  SITE (170)..(170): Xaa at position 170 is Ala, Gly, or Pro
  SITE (171)..(171): Xaa at position 171 is Phe, Tyr, Met, His, Ile, Leu, Val Ala, or Gly
  SITE (190)..(190): Xaa at position 190 is Val, Ala, Gly, Leu, or Ile
  SITE (192)..(192): Xaa at position 192 is Phe, Tyr, Met, His, Ile, Leu, Val Ala, or Gly
MGSPRSALSCLLLHLLVLCLQAQEGPGRGPALGRELASLFRAGREPQGVSQQHVREQSLVTDQLSRRLIRTYQXYSRTSGKHXQXLANKRINXMXEDGDPFXKLIVETDTFGSRVRVRGAETGLYXXXNKKGKLXAKSNGKGKDXVXTEIVLENNYTXLQNAKYEGWYXXXTRKGRPRKGSKTRQHQREXHXMKRLPRGHHTTEQSLRFEFLNYPPFTRSLRGSQRTWAPEPR

SEQ ID NO: 576 - protein, 1798 aa, Homo sapiens
  SITE (519)..(519): Xaa at position 519 is Cys, Ala, Val, Gly, Ser, or Thr
MELTSRERGRGQPLPWELRLGLLLSVLAATLAQAPAPDVPGCSRGSCYPATGDLLVGRADRLTASSTCGLNGPQPYCIVSHLQDEKKCFLCDSRRPFSARDNPHSHRIQNVVTSFAPQRRAAWWQSENGIPAVTIQLDLEAEFHFTHLIMTFKTFRPAAMLVERSADFGRTWHVYRYFSYDCGADFPGVPLAPPRHWDDVVCESRYSEIEPSTEGEVIYRVLDPAIPIPDPYSSRIQNLLKITNLRVNLTRLHTLGDNLLDPRREIREKYYYALYELVVRGNCFCYGHASECAPAPGAPAHAEGMVHGACICKHNTRGLNCEQCQDFYRDLPWRPAEDGHSHACRKCECHGHTHSCHFDMAVYLASGNVSGGVCDGCQHNTAGRHCELCRPFFYRDPTKDLRDPAVCRSCDCDPMGSQDGGRCDSHDDPALGLVSGQCRCKEHVVGTRCQQCRDGFFGLSISDRLGCRRCQCNARGTVPGSTPCDPNSGSCYCKRLVTGRGCDRCLPGHWGLSHDLLGXRPCDCDVGGALDPQCDEGTGQCHCRQHMVGRRCEQVQPGYFRPFLDHLIWEAEDTRGQVLDVVERLVTPGETPSWTGSGFVRLQEGQTLEFLVASVPKAMDYDLLLRLEPQVPEQWAELELIVQRPGPVPAHSLCGHLVPKDDRIQGTLQPHARYLIFPNPVCLEPGISYKLHLKLVRTGGSAQPETPYSGPGLLIDSLVLLPRVLVLEMFSGGDAAALERQATFERYQCHEEGLVPSKTSPSEACAPLLISLSTLIYNGALPCQCNPQGSLSSECNPHGGQCLCKPGVVGRRCDLCAPGYYGFGPTGCQACQCSHEGALSSLCEKTSGQCLCRTGAFGLRCDRCQRGQWGFPSCRPCVCNGHADECNTHTGACLGCRDHTGGEHCERCIAGFHGDPRLPYGGQCRPCPCPEGPGSQRHFATSCHQDEYSQQIVCHCRAGYTGLRCEACAPGHFGDPSRPGGRCQLCECSGNIDPMDPDACDPHTGQCLRCLHHTEGPHCAHCKPGFHGQAARQSCHRCTCNLLGTNPQQCPSPDQCHCDPSSGQCPCLPNVQGPSCDRCAPNFWNLTSGHGCQPCACHPSRARGPTCNEFTGQCHCRAGFGGRTCSECQELHWGDPGLQCHACDCDSRGIDTPQCHRFTGHCSCRPGVSGVRCDQCARGFSGIFPACHPCHACFGDWDRVVQDLAARTQRLEQRAQELQQTGVLGAFESSFWHMQEKLGIVQGIVGARNTSAASTAQLVEATEELRREIGEATEHLTQLEADLTDVQDENFNANHALSGLERDRLALNLTLRQLDQHLDLLKHSNFLGAYDSIRHAHSQSAEAERRANTSALAVPSPVSNSASARHRTEALMDAQKEDFNSKHMANQRALGKLSAHTHTLSLTDINELVCGAPGDAPCATSPCGGAGCRDEDGQPRCGGLSCNGAAATADLALGRARHTQAELQRALAEGGSILSRVAETRRQASEAQQRAQAALDKANASRGQVEQANQELQELIQSVKDFLNQEGADPDSIEMVATRVLELSIPASAEQIQHLAGAIAERVRSLADVDAILARTVGDVRRAEQLLQDARRARSWAEDEKQKAETVQAALEEAQRAQGIAQGAIRGAVADTRDTEQTLYQVQERMAGAERALSSAGERARQLDALLEALKLKRAGNSLAASTAEETAGSAQGRAQEAEQLLRGPLGDQYQTVKALAERKAQGVLAAQARAEQLRDEARDLLQAAQDKLQRLQELEGTYEENERALESKAAQLDGLEARMRSVLQAINLQVQIYNTCQ

SEQ ID NO: 577 - protein, 799 aa, Homo sapiens
  SITE (70)..(70): Xaa at position 70 is Val, Ala, Gly, Leu, or Ile
  SITE (109)..(109): Xaa at position 109 is Phe, Tyr, Met, His, Ile, Leu, Val Ala, or Gly
  SITE (118)..(118): Xaa at position 118 is Ile, Ala, Val, Leu, or Gly
  SITE (120)..(120): Xaa at position 120 is Ala, Gly, or Pro
  SITE (124)..(124): Xaa at position 124 is Leu, Ala, Val, Gly, or Ile
  SITE (134)..(134): Xaa at position 134 is Leu, Ala, Val, Gly, or Ile
  SITE (138)..(138): Xaa at position 138 is Ala, Gly, or Pro
  SITE (154)..(154): Xaa at position 154 is Ile, Ala, Val, Leu, or Gly
  SITE (155)..(155): Xaa at position 155 is Ile, Ala, Val, Leu, or Gly
  SITE (157)..(157): Xaa at position 157 is Val, Ala, Gly, Leu, or Ile
  SITE (176)..(176): Xaa at position 176 is Val, Ala, Gly, Leu, or Ile
  SITE (189)..(189): Xaa at position 189 is Val, Ala, Gly, Leu, or Ile
  SITE (223)..(223): Xaa at position 223 is Ala, Gly, or Pro
  SITE (224)..(224): Xaa at position 224 is Ile, Ala, Val, Leu, or Gly
  SITE (225)..(225): Xaa at position 225 is Ile, Ala, Val, Leu, or Gly
  SITE (242)..(242): Xaa at position 242 is Val, Ala, Gly, Leu, or Ile
  SITE (244)..(244): Xaa at position 244 is Ile, Ala, Val, Leu, or Gly
  SITE (246)..(246): Xaa at position 246 is Ala, Gly, or Pro
  SITE (262)..(262): Xaa at position 262 is Leu, Ala, Val, Gly, or Ile
  SITE (264)..(264): Xaa at position 264 is Val, Ala, Gly, Leu, or Ile
  SITE (300)..(300): Xaa at position 300 is Ala, Gly, or Pro
  SITE (324)..(324): Xaa at position 324 is Phe, Tyr, Met, His, Ile, Leu, Val Ala, or Gly
  SITE (353)..(353): Xaa at position 353 is Leu, Ala, Val, Gly, or Ile
  SITE (355)..(355): Xaa at position 355 is Val, Ala, Gly, Leu, or Ile
  SITE (357)..(357): Xaa at position 357 is Ala, Gly, or Pro
  SITE (378)..(378): Xaa at position 378 is Val, Ala, Gly, Leu, or Ile
  SITE (380)..(380): Xaa at position 380 is Ile, Ala, Val, Leu, or Gly
MPERLAEMLLDLWTPLIILWITLPPCIYMAPMNQSQVLMSGSPLELNSLGEEQRILNRSKRGWVWNQMFXLEEFSGPEPILVGRLHTDLDPGSKKIKYILSGDGAGTIXQINDVTGDXHXIKRXDREEKAEYTXTAQXVDWETSKPLEPPSEFXXKXQDINDNAPEFLNGPYHATXPEMSILGTSVTNXTATDADDPVYGNSAKLVYSILEGQPYFSIEPETXXXKTALPNMDREAKEEYLXVXQXKDMGGHSGGLSGTTTXTXTLTDVNDNPPKFAQSLYHFSVPEDVVLGTAIGRVKXNDQDIGENAQSSYDIIDGDGTALXEITSDAQAQDGIIRLRKPLDFETKKSYTXKXEXANVHIDPRFSGRGPFKDTATXKXVVEDADEPPVFSSPTYLLEVHENAALNSVIGQVTARDPDITSSPIRFSIDRHTDLERQFNINADDGKITLATPLDRELSVWHNITIIATEIRNHSQISRVPVAIKVLDVNDNAPEFASEYEAFLCENGKPGQVIQTVSAMDKDDPKNGHYFLYSLLPEMVNNPNFTIKKNEDNSLSILAKHNGFNRQKQEVYLLPIIISDSGNPPLSSTSTLTIRVCGCSNDGVVQSCNVEAYVLPIGLSMGALIAILACIILLLVIVVLFVTLRRHKNEPLIIKDDEDVRENIIRYDDEGGGEEDTEAFDIATLQNPDGINGFLPRKDIKPDLQFMPRQGLAPVPNGVDVDEFINVRLHEADNDPTAPPYDSIQIYGYEGRGSVAGSLSSLESTTSDSDQNFDYLSDWGPRFKRLGELYSVGESDKET

SEQ ID NO: 578 - protein, 814 aa, Homo sapiens
  SITE (138)..(138): Xaa at position 138 is Leu, Ala, Val, Gly, or Ile
MDAAFLLVLGLLAQSLCLSLGVPGWRRPTTLYPWRRAPALSRVRRAWVIPPISVSENHKRLPYPLVQIKSDKQQLGSVIYSIQGPGVDEEPRGVFSIDKFTGKVFLNAMLDREKTDRFRLRAFALDLGGSTLEDPTDXEIVVVDQNDNRPAFLQEAFTGRVLEGAVPGTYVTRAEATDADDPETDNAALRFSILQQGSPELFSIDELTGEIRTVQVGLDREVVAVYNLTLQVADMSGDGLTATASAIITLDDINDNAPEFTRDEFFMEAIEAVSGVDVGRLEVEDRDLPGSPNWVARFTILEGDPDGQFTIRTDPKTNEGVLSIVKALDYESCEHYELKVSVQNEAPLQAAALRAERGQAKVRVHVQDTNEPPVFQENPLRTSLAEGAPPGTLVATFSARDPDTEQLQRLSYSKDYDPEDWLQVDAATGRIQTQHVLSPASPFLKGGWYRAIVLAQDDASQPRTATGTLSIEILEVNDHAPVLAPPPPGSLCSEPHQGPGLLLGATDEDLPPHGAPFHFQLSPRLPELGRNWSLSQVNVSHARLRPRHQVPEGLHRLSLLLRDSGQPPQQREQPLNVTVCRCGKDGVCLPGAAALLAGGTGLSLGALVIVLASALLLLVLVLLVALRARFWKQSRGKGLLHGPQDDLRDNVLNYDEQGGGEEDQDAYDISQLRHPTALSLPLGPPPLRRDAPQGRLHPQPPRVLPTSPLDIADFINDGLEAADSDPSVPPYDTALIYDYEGDGSVAGTLSSILSSQGDEDQDYDYLRDWGPRFARLADMYGHPCGLEYGARWDHQAREGLSPGALLPRHRGRTA

SEQ ID NO: 579 - protein, 205 aa, Homo sapiens
  SITE (114)..(114): Xaa at position 114 is Ala, Gly, or Pro
  SITE (115)..(115): Xaa at position 115 is Ala, Gly, or Pro
  SITE (146)..(146): Xaa at position 146 is Ala, Gly, or Pro
  SITE (153)..(153): Xaa at position 153 is Leu, Ala, Val, Gly, or Ile
  SITE (166)..(166): Xaa at position 166 is Phe, Tyr, Met, His, Ile, Leu, Val Ala, or Gly
  SITE (170)..(170): Xaa at position 170 is Leu, Ala, Val, Gly, or Ile
  SITE (171)..(171): Xaa at position 171 is Cys, Ala, Val, Gly, Ser, or Thr
MAAPGERGRFHGGNLFFLPGGARSEMMDDLATDARGRGAGRRDAAASASTPAQAPTSDSPVAEDASRRRPCRACVDFKTWMRTQQKRDTKFREDCPPDREELGRHSWAVLHTLXXYYPDLPTPEQQQDMAQFIHLFSKFYPCEECXEDLRKRXCRNHPDTRTRACXTQWXXHLHNEVNRKLGKPDFDCSKVDERWRDGWKDGSCD

SEQ ID NO: 580 - protein, 245 aa, Homo sapiens
  SITE (7)..(7): Xaa at position 7 is Phe, Tyr, Met, His, Ile, Leu, Val Ala, or Gly
  SITE (13)..(13): Xaa at position 13 is Ile, Ala, Val, Leu, or Gly
  SITE (17)..(17): Xaa at position 17 is Ala, Gly, or Pro
  SITE (23)..(23): Xaa at position 23 is Tyr, Phe, Met, His, Ile, Leu, Val Ala, or Gly
  SITE (24)..(24): Xaa at position 24 is Cys, Ala, Val, Gly, Ser, or Thr
  SITE (25)..(25): Xaa at position 25 is Leu, Ala, Val, Gly, or Ile
  SITE (26)..(26): Xaa at position 26 is Val, Ala, Gly, Leu, or Ile
  SITE (27)..(27): Xaa at position 27 is Ala, Gly, or Pro
  SITE (34)..(34): Xaa at position 34 is Phe, Tyr, Met, His, Ile, Leu, Val Ala, or Gly
  SITE (38)..(38): Xaa at position 38 is Phe, Tyr, Met, His, Ile, Leu, Val Ala, or Gly
  SITE (49)..(49): Xaa at position 49 is Val, Ala, Gly, Leu, or Ile
  SITE (53)..(53): Xaa at position 53 is Ile, Ala, Val, Leu, or Gly
  SITE (59)..(59): Xaa at position 59 is Ile, Ala, Val, Leu, or Gly
  SITE (64)..(64): Xaa at position 64 is Val, Ala, Gly, Leu, or Ile
  SITE (70)..(70): Xaa at position 70 is Leu, Ala, Val, Gly, or Ile
  SITE (71)..(71): Xaa at position 71 is Leu, Ala, Val, Gly, or Ile
  SITE (72)..(72): Xaa at position 72 is Val, Ala, Gly, Leu, or Ile
  SITE (84)..(84): Xaa at position 84 is Ile, Ala, Val, Leu, or Gly
  SITE (97)..(97): Xaa at position 97 is Val, Ala, Gly, Leu, or Ile
  SITE (104)..(104): Xaa at position 104 is Leu, Ala, Val, Gly, or Ile
  SITE (107)..(107): Xaa at position 107 is Val, Ala, Gly, Leu, or Ile
  SITE (115)..(115): Xaa at position 115 is Ala, Gly, or Pro
  SITE (116)..(116): Xaa at position 116 is Leu, Ala, Val, Gly, or Ile
  SITE (117)..(117): Xaa at position 117 is Val, Ala, Gly, Leu, or Ile
  SITE (129)..(129): Xaa at position 129 is Leu, Ala, Val, Gly, or Ile
  SITE (133)..(133): Xaa at position 133 is Leu, Ala, Val, Gly, or Ile
  SITE (142)..(142): Xaa at position 142 is Val, Ala, Gly, Leu, or Ile
  SITE (148)..(148): Xaa at position 148 is Val, Ala, Gly, Leu, or Ile
  SITE (153)..(153): Xaa at position 153 is Val, Ala, Gly, Leu, or Ile
  SITE (160)..(160): Xaa at position 160 is Leu, Ala, Val, Gly, or Ile
  SITE (161)..(161): Xaa at position 161 is Val, Ala, Gly, Leu, or Ile
  SITE (173)..(173): Xaa at position 173 is Leu, Ala, Val, Gly, or Ile
  SITE (177)..(177): Xaa at position 177 is Leu, Ala, Val, Gly, or Ile
  SITE (179)..(179): Xaa at position 179 is Val, Ala, Gly, Leu, or Ile
  SITE (186)..(186): Xaa at position 186 is Val, Ala, Gly, Leu, or Ile
  SITE (193)..(193): Xaa at position 193 is Ile, Ala, Val, Leu, or Gly
  SITE (194)..(194): Xaa at position 194 is Ala, Gly, or Pro
  SITE (197)..(197): Xaa at position 197 is Met, Ile, Leu, Val, Ala, or Gly
  SITE (198)..(198): Xaa at position 198 is Val, Ala, Gly, Leu, or Ile
  SITE (203)..(203): Xaa at position 203 is Cys, Ala, Val, Gly, Ser, or Thr
  SITE (204)..(204): Xaa at position 204 is Ala, Gly, or Pro
  SITE (205)..(205): Xaa at position 205 is Phe, Tyr, Met, His, Ile, Leu, Val Ala, or Gly
  SITE (206)..(206): Xaa at position 206 is Cys, Ala, Val, Gly, Ser, or Thr
  SITE (218)..(218): Xaa at position 218 is Val, Ala, Gly, Leu, or Ile
  SITE (222)..(222): Xaa at position 222 is Phe, Tyr, Met, His, Ile, Leu, Val Ala, or Gly
MAVRASXENNCEXGCFXKLTNTXXXXXIGGSENXYSVXEGELSDTIPVXHASXAGCRIXGRMCXGNRHGXXXPNNTTDQELQHXRNSLPDTVQIRRXEERLSAXGNXTTCNDYVXXXHPDLDRETEEIXADVXKVEVFRQTXADQVLXGSYCXFSNQGGXXHPKTSIEDQDEXSSLXQXPLVAGTXNRGSEVXXAGXXVNDWXXXXGLDTTSTELSVXESVXKLNEAQPSTIATSMRDSLIDSLT

SEQ ID NO: 581 - protein, 661 aa, Homo sapiens
  SITE (28)..(28): Xaa at position 28 is Leu, Ala, Val, Gly, or Ile
  SITE (38)..(38): Xaa at position 38 is Ala, Gly, or Pro
  SITE (41)..(41): Xaa at position 41 is Ala, Gly, or Pro
  SITE (42)..(42): Xaa at position 42 is Leu, Ala, Val, Gly, or Ile
  SITE (53)..(53): Xaa at position 53 is Ala, Gly, or Pro
  SITE (57)..(57): Xaa at position 57 is Leu, Ala, Val, Gly, or Ile
MAAGETQLYAKVSNKLKSRSSPSLLEPXLAMGFPVHTXLKXXAATGRKTAEEXLAWXHDHCNDPSLDDPIPQEYALFLCPTGPLLEKLQEFWRESKRQCAKNRAHEVFPHVTLCDFFTCEDQKVECLYEALKRAGDRLLGSFPTAVPLALHSSISYLGFFVSGSPADVIREFAMTFATEASLLAGTSVSRFWIFSQVPGHGPNLRLSNLTRASFVSHYILQKYCSVKPCTKQLHLTLAHKFYPHHQRTLEQLARAIPLGHSCQWTAALYSRDMRFVHYQTLRALFQYKPQNVDELTLSPGDYIFVDPTQQDEASEGWVIGISQRTGCRGFLPENYTDRASESDTWVKHRMYTFSLATDLNSRKDGEASSRCSGEFLPQTARSLSSLQALQATVARKSVLVVRHGERVDQIFGKAWLQQCSTPDGKYYRPDLNFPCSLPRRSRGIKDFENDPPLSSCGIFQSRIAGDALLDSGIRISSVFASPALRCVQTAKLILEELKLEKKIKIRVEPGIFEWTKWEAGKTTPTLMSLEELKEANFNIDTDYRPAFPLSALMPAESYQEYMDRCTASMVQIVNTCPQDTGVILIVSHGSTLDSCTRPLLGLPPRECGDFAQLVRKIPSLGMCFCEENKEEGKWELVNPPVKTLTHGANAAFNWRNWISGN

SEQ ID NO: 582 - protein, 213 aa, Homo sapiens
  SITE (15)..(15): Xaa at position 15 is Val, Ala, Gly, Leu, or Ile
  SITE (16)..(16): Xaa at position 16 is Val, Ala, Gly, Leu, or Ile
  SITE (17)..(17): Xaa at position 17 is Leu, Ala, Val, Gly, or Ile
  SITE (18)..(18): Xaa at position 18 is Ile, Ala, Val, Leu, or Gly
  SITE (23)..(23): Xaa at position 23 is Val, Ala, Gly, Leu, or Ile
  SITE (28)..(28): Xaa at position 28 is Leu, Ala, Val, Gly, or Ile
  SITE (29)..(29): Xaa at position 29 is Leu, Ala, Val, Gly, or Ile
  SITE (47)..(47): Xaa at position 47 is Val, Ala, Gly, Leu, or Ile
  SITE (60)..(60): Xaa at position 60 is Ala, Gly, or Pro
  SITE (61)..(61): Xaa at position 61 is Val, Ala, Gly, Leu, or Ile
  SITE (63)..(63): Xaa at position 63 is Ala, Gly, or Pro
  SITE (65)..(65): Xaa at position 65 is Ile, Ala, Val, Leu, or Gly
  SITE (69)..(69): Xaa at position 69 is Ala, Gly, or Pro
  SITE (74)..(74): Xaa at position 74 is Tyr, Phe, Met, His, Ile, Leu, Val Ala, or Gly
  SITE (76)..(76): Xaa at position 76 is Ala, Gly, or Pro
  SITE (81)..(81): Xaa at position 81 is Tyr, Phe, Met, His, Ile, Leu, Val Ala, or Gly
  SITE (82)..(82): Xaa at position 82 is Tyr, Phe, Met, His, Ile, Leu, Val Ala, or Gly
  SITE (85)..(85): Xaa at position 85 is Ala, Gly, or Pro
  SITE (88)..(88): Xaa at position 88 is Ala, Gly, or Pro
  SITE (89)..(89): Xaa at position 89 is Leu, Ala, Val, Gly, or Ile
  SITE (90)..(90): Xaa at position 90 is Leu, Ala, Val, Gly, or Ile
  SITE (91)..(91): Xaa at position 91 is Val, Ala, Gly, Leu, or Ile
  SITE (92)..(92): Xaa at position 92 is Phe, Tyr, Met, His, Ile, Leu, Val Ala, or Gly
  SITE (94)..(94): Xaa at position 94 is Leu, Ala, Val, Gly, or Ile
  SITE (103)..(103): Xaa at position 103 is Val, Ala, Gly, Leu, or Ile
  SITE (110)..(110): Xaa at position 110 is Leu, Ala, Val, Gly, or Ile
  SITE (120)..(120): Xaa at position 120 is Val, Ala, Gly, Leu, or Ile
  SITE (121)..(121): Xaa at position 121 is Met, Ile, Leu, Val, Ala, or Gly
  SITE (122)..(122): Xaa at position 122 is Leu, Ala, Val, Gly, or Ile
  SITE (123)..(123): Xaa at position 123 is Val, Ala, Gly, Leu, or Ile
  SITE (135)..(135): Xaa at position 135 is Val, Ala, Gly, Leu, or Ile
  SITE (140)..(140): Xaa at position 140 is Ala, Gly, or Pro
  SITE (144)..(144): Xaa at position 144 is Ala, Gly, or Pro
  SITE (156)..(156): Xaa at position 156 is Ala, Gly, or Pro
  SITE (157)..(157): Xaa at position 157 is Leu, Ala, Val, Gly, or Ile
  SITE (162)..(162): Xaa at position 162 is Val, Ala, Gly, Leu, or Ile
  SITE (165)..(165): Xaa at position 165 is Ala, Gly, or Pro
  SITE (166)..(166): Xaa at position 166 is Phe, Tyr, Met, His, Ile, Leu, Val Ala, or Gly
  SITE (169)..(169): Xaa at position 169 is Val, Ala, Gly, Leu, or Ile
  SITE (170)..(170): Xaa at position 170 is Leu, Ala, Val, Gly, or Ile
  SITE (173)..(173): Xaa at position 173 is Ile, Ala, Val, Leu, or Gly
MGNGTEEDYNFVFKXXXXGESGXGKTNXXSRFTRNEFSHDSRTTIGXEFSTRTVMLGTAXXKXQXWDTXGLERXRXITSAXXRGXVGXXXXXDXTKHQTYAVXERWLKEXYDHAEATIVXXXXGNKSDLSQAREXPTEEXRMFXENNGLLFLETSXXDSTNXELXXETXXKEXFAKVSKQRQNSIRTNAITLGSAQAGQEPGPGEKRACCISL

SEQ ID NO: 583 - protein, 489 aa, Homo sapiens
  SITE (43)..(43): Xaa at position 43 is Phe, Tyr, Met, His, Ile, Leu, Val Ala, or Gly
  SITE (45)..(45): Xaa at position 45 is Leu, Ala, Val, Gly, or Ile
  SITE (46)..(46): Xaa at position 46 is Tyr, Phe, Met, His, Ile, Leu, Val Ala, or Gly
  SITE (47)..(47): Xaa at position 47 is Phe, Tyr, Met, His, Ile, Leu, Val Ala, or Gly
  SITE (48)..(48): Xaa at position 48 is Val, Ala, Gly, Leu, or Ile
  SITE (49)..(49): Xaa at position 49 is Leu, Ala, Val, Gly, or Ile
  SITE (55)..(55): Xaa at position 55 is Val, Ala, Gly, Leu, or Ile
  SITE (62)..(62): Xaa at position 62 is Ile, Ala, Val, Leu, or Gly
  SITE (66)..(66): Xaa at position 66 is Val, Ala, Gly, Leu, or Ile
  SITE (69)..(69): Xaa at position 69 is Leu, Ala, Val, Gly, or Ile
  SITE (70)..(70): Xaa at position 70 is Ala, Gly, or Pro
  SITE (80)..(80): Xaa at position 80 is Leu, Ala, Val, Gly, or Ile
  SITE (82)..(82): Xaa at position 82 is Phe, Tyr, Met, His, Ile, Leu, Val Ala, or Gly
  SITE (83)..(83): Xaa at position 83 is Ile, Ala, Val, Leu, or Gly
  SITE (84)..(84): Xaa at position 84 is Val, Ala, Gly, Leu, or Ile
  SITE (85)..(85): Xaa at position 85 is Phe, Tyr, Met, His, Ile, Leu, Val Ala, or Gly
  SITE (91)..(91): Xaa at position 91 is Ile, Ala, Val, Leu, or Gly
  SITE (102)..(102): Xaa at position 102 is Ile, Ala, Val, Leu, or Gly
  SITE (109)..(109): Xaa at position 109 is Leu, Ala, Val, Gly, or Ile
  SITE (120)..(120): Xaa at position 120 is Ile, Ala, Val, Leu, or Gly
  SITE (124)..(124): Xaa at position 124 is Leu, Ala, Val, Gly, or Ile
  SITE (127)..(127): Xaa at position 127 is Ala, Gly, or Pro
  SITE (131)..(131): Xaa at position 131 is Ile, Ala, Val, Leu, or Gly
  SITE (142)..(142): Xaa at position 142 is Ile, Ala, Val, Leu, or Gly
  SITE (143)..(143): Xaa at position 143 is Ile, Ala, Val, Leu, or Gly
  SITE (144)..(144): Xaa at position 144 is Ile, Ala, Val, Leu, or Gly
  SITE (145)..(145): Xaa at position 145 is Ala, Gly, or Pro
  SITE (146)..(146): Xaa at position 146 is Leu, Ala, Val, Gly, or Ile
  SITE (159)..(159): Xaa at position 159 is Ala, Gly, or Pro
  SITE (163)..(163): Xaa at position 163 is Ala, Gly, or Pro
  SITE (173)..(173): Xaa at position 173 is Val, Ala, Gly, Leu, or Ile
  SITE (174)..(174): Xaa at position 174 is Tyr, Phe, Met, His, Ile, Leu, Val Ala, or Gly
  SITE (175)..(175): Xaa at position 175 is Cys, Ala, Val, Gly, Ser, or Thr
  SITE (176)..(176): Xaa at position 176 is Val, Ala, Gly, Leu, or Ile
  SITE (178)..(178): Xaa at position 178 is Val, Ala, Gly, Leu, or Ile
  SITE (186)..(186): Xaa at position 186 is Leu, Ala, Val, Gly, or Ile
  SITE (189)..(189): Xaa at position 189 is Ile, Ala, Val, Leu, or Gly
  SITE (206)..(206): Xaa at position 206 is Leu, Ala, Val, Gly, or Ile
  SITE (209)..(209): Xaa at position 209 is Ile, Ala, Val, Leu, or Gly
  SITE (213)..(213): Xaa at position 213 is Ile, Ala, Val, Leu, or Gly
MVAERSPARSPGSWLFPGLWLLVLSGPGGLLRAQEQPSCRRAXDXXXXXDKSGSXANNWIEXYNFXQQXXERFVSPEMRXSXXXXSSQATXILPLTGDRGKXSKGLEDXKRVSPVGETYXHEGXKLXNEQXQKAGGLKTSSXXXXXTDGKLDGLVPSYXEKEXKISRSLGASXXXXGXLDFEQAQXERXADSKEQVFPVKGGFQAXKGXINSXLAQSCTEILELQPSSVCVGEEFQIVLSGRGFMLGSRNGSVLCTYTVNETYTTSVKPVSVQLNSMLCPAPILNKAGETLDVSVSFNGGKSVISGSLIVTATECSNGIAAIIVILVLLLLLGIGLMWWFWPLCCKVVIKDPPPPPAPAPKEEEEEPLPTKKWPTVDASYYGGRGVGGIKRMEVRWGDKGSTEEGARLEKAKNAVVKIPEETEEPIRPRPPRPKPTHQPPQTKWYTPIKGRLDALWALLRRQYDRVSLMRPQEGDEVCIWECIEKELTA

SEQ ID NO: 584 - protein, 1255 aa, Human SARS coronavirus
  SARS-CoV (Severe acute respiratory syndrome coronavirus)
  SITE (328)..(328): Xaa at position 328 is Val, Ala, Gly, Leu, or Ile
  SITE (337)..(337): Xaa at position 337 is Val, Ala, Gly, Leu, or Ile
  SITE (345)..(345): Xaa at position 345 is Ile, Ala, Val, Leu, or Gly
  SITE (350)..(350): Xaa at position 350 is Ala, Gly, or Pro
  SITE (374)..(374): Xaa at position 374 is Leu, Ala, Val, Gly, or Ile
  SITE (382)..(382): Xaa at position 382 is Val, Ala, Gly, Leu, or Ile
  SITE (384)..(384): Xaa at position 384 is Ala, Gly, or Pro
  SITE (387)..(387): Xaa at position 387 is Phe, Tyr, Met, His, Ile, Leu, Val Ala, or Gly
  SITE (388)..(388): Xaa at position 388 is Val, Ala, Gly, Leu, or Ile
  SITE (389)..(389): Xaa at position 389 is Val, Ala, Gly, Leu, or Ile
  SITE (397)..(397): Xaa at position 397 is Ile, Ala, Val, Leu, or Gly
  SITE (398)..(398): Xaa at position 398 is Ala, Gly, or Pro
  SITE (405)..(405): Xaa at position 405 is Ile, Ala, Val, Leu, or Gly
  SITE (406)..(406): Xaa at position 406 is Ala, Gly, or Pro
  SITE (410)..(410): Xaa at position 410 is Tyr, Phe, Met, His, Ile, Leu, Val Ala, or Gly
  SITE (412)..(412): Xaa at position 412 is Leu, Ala, Val, Gly, or Ile
  SITE (419)..(419): Xaa at position 419 is Cys, Ala, Val, Gly, Ser, or Thr
  SITE (420)..(420): Xaa at position 420 is Val, Ala, Gly, Leu, or Ile
  SITE (421)..(421): Xaa at position 421 is Leu, Ala, Val, Gly, or Ile
  SITE (422)..(422): Xaa at position 422 is Ala, Gly, or Pro
  SITE (483)..(483): Xaa at position 483 is Phe, Tyr, Met, His, Ile, Leu, Val Ala, or Gly
  SITE (496)..(496): Xaa at position 496 is Val, Ala, Gly, Leu, or Ile
  SITE (497)..(497): Xaa at position 497 is Val, Ala, Gly, Leu, or Ile
  SITE (498)..(498): Xaa at position 498 is Val, Ala, Gly, Leu, or Ile
  SITE (499)..(499): Xaa at position 499 is Leu, Ala, Val, Gly, or Ile
  SITE (510)..(510): Xaa at position 510 is Val, Ala, Gly, Leu, or Ile
MFIFLLFLTLTSGSDLDRCTTFDDVQAPNYTQHTSSMRGVYYPDEIFRSDTLYLTQDLFLPFYSNVTGFHTINHTFGNPVIPFKDGIYFAATEKSNVVRGWVFGSTMNNKSQSVIIINNSTNVVIRACNFELCDNPFFAVSKPMGTQTHTMIFDNAFNCTFEYISDAFSLDVSEKSGNFKHLREFVFKNKDGFLYVYKGYQPIDVVRDLPSGFNTLKPIFKLPLGINITNFRAILTAFSPAQDIWGTSAAAYFVGYLKPTTFMLKYDENGTITDAVDCSQNPLAELKCSVKSFEIDKGIYQTSNFRVVPSGDVVRFPNITNLCPFGEXFNATKFPSXYAWERKKXSNCVXDYSVLYNSTFFSTFKCYGVSATKXNDLCFSNXYXDSXXXKGDDVRQXXPGQTGVXXDYNXKXPDDFMGXXXXWNTRNIDATSTGNYNYKYRYLRHGKLRPFERDISNVPFSPDGKPCTPPALNCYWPLNDYGXYTTTGIGYQPYRXXXXSFELLNAPATXCGPKLSTDLIKNQCVNFNFNGLTGTGVLTPSSKRFQPFQQFGRDVSDFTDSVRDPKTSEILDISPCSFGGVSVITPGTNASSEVAVLYQDVNCTDVSTAIHADQLTPAWRIYSTGNNVFQTQAGCLIGAEHVDTSYECDIPIGAGICASYHTVSLLRSTSQKSIVAYTMSLGADSSIAYSNNTIAIPTNFSISITTEVMPVSMAKTSVDCNMYICGDSTECANLLLQYGSFCTQLNRALSGIAAEQDRNTREVFAQVKQMYKTPTLKYFGGFNFSQILPDPLKPTKRSFIEDLLFNKVTLADAGFMKQYGECLGDINARDLICAQKFNGLTVLPPLLTDDMIAAYTAALVSGTATAGWTFGAGAALQIPFAMQMAYRFNGIGVTQNVLYENQKQIANQFNKAISQIQESLTTTSTALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQAAPHGVVFLHVTYVPSQERNFTTAPAICHEGKAYFPREGVFVFNGTSWFITQRNFFSPQIITTDNTFVSGNCDVVIGIINNTVYDPLQPELDSFKEELDKYFKNHTSPDVDLGDISGINASVVNIQKEIDRLNEVAKNLNESLIDLQELGKYEQYIKWPWYVWLGFIAGLIAIVMVTILLCCMTSCCSCLKGACSCGSCCKFDEDDSEPVLKGVKLHYT

SEQ ID NO: 585 - protein, 236 aa, Homo sapiens
  SITE (127)..(127): Xaa at position 127 is Tyr, Phe, Met, His, Ile, Leu, Val Ala, or Gly
  SITE (131)..(131): Xaa at position 131 is Leu, Ala, Val, Gly, or Ile
  SITE (134)..(134): Xaa at position 134 is Ala, Gly, or Pro
  SITE (147)..(147): Xaa at position 147 is Val, Ala, Gly, Leu, or Ile
  SITE (151)..(151): Xaa at position 151 is His, Phe, Tyr, Lys, Arg, Gly, Ser Thr, Ala, Val, Leu, Ile, Asn, Met, or Gln
  SITE (156)..(156): Xaa at position 156 is Cys, Ala, Val, Gly, Ser, or Thr
  SITE (169)..(169): Xaa at position 169 is Val, Ala, Gly, Leu, or Ile
  SITE (174)..(174): Xaa at position 174 is Leu, Ala, Val, Gly, or Ile
  SITE (190)..(190): Xaa at position 190 is Cys, Ala, Val, Gly, Ser, or Thr
  SITE (194)..(194): Xaa at position 194 is Ile, Ala, Val, Leu, or Gly
MGVEGCTKCIKYLLFVFNFVFWLAGGVILGVALWLRHDPQTTNLLYLELGDKPAPNTFYVGIYILIAVGAVMMFVGFLGCYGAIQESQCLLGTFFTCLVILFACEVAAGIWGFVNKDQIAKDVKQFXDQAXQQXVVDDDANNAKAVXKTFXETLDXCGSSTLTALTTSXLKNNXCPSGSNIISNLFKEDXHQKXDDLFSGKLYLIGIAAIVVAVIMIFEMILSMVLCCGIRNSSVY

SEQ ID NO: 586 - protein, 403 aa, Homo sapiens
  SITE (25)..(25): Xaa at position 25 is Leu, Ala, Val, Gly, or Ile
  SITE (33)..(33): Xaa at position 33 is Ile, Ala, Val, Leu, or Gly
  SITE (34)..(34): Xaa at position 34 is Ala, Gly, or Pro
  SITE (35)..(35): Xaa at position 35 is Met, Ile, Leu, Val, Ala, or Gly
  SITE (39)..(39): Xaa at position 39 is Ala, Gly, or Pro
  SITE (50)..(50): Xaa at position 50 is Ile, Ala, Val, Leu, or Gly
  SITE (53)..(53): Xaa at position 53 is Val, Ala, Gly, Leu, or Ile
  SITE (56)..(56): Xaa at position 56 is Phe, Tyr, Met, His, Ile, Leu, Val Ala, or Gly
  SITE (57)..(57): Xaa at position 57 is Leu, Ala, Val, Gly, or Ile
  SITE (67)..(67): Xaa at position 67 is Ile, Ala, Val, Leu, or Gly
  SITE (68)..(68): Xaa at position 68 is Tyr, Phe, Met, His, Ile, Leu, Val Ala, or Gly
  SITE (70)..(70): Xaa at position 70 is Leu, Ala, Val, Gly, or Ile
  SITE (101)..(101): Xaa at position 101 is Ile, Ala, Val, Leu, or Gly
  SITE (104)..(104): Xaa at position 104 is Phe, Tyr, Met, His, Ile, Leu, Val Ala, or Gly
  SITE (105)..(105): Xaa at position 105 is Cys, Ala, Val, Gly, Ser, or Thr
  SITE (108)..(108): Xaa at position 108 is Leu, Ala, Val, Gly, or Ile
  SITE (120)..(120): Xaa at position 120 is Ala, Gly, or Pro
  SITE (121)..(121): Xaa at position 121 is Ala, Gly, or Pro
  SITE (122)..(122): Xaa at position 122 is Ile, Ala, Val, Leu, or Gly
  SITE (123)..(123): Xaa at position 123 is His, Phe, Tyr, Lys, Arg, Gly, Ser Thr, Ala, Val, Leu, Ile, Asn, Met, or Gln
  SITE (126)..(126): Xaa at position 126 is Ala, Gly, or Pro
  SITE (133)..(133): Xaa at position 133 is Val, Ala, Gly, Leu, or Ile
  SITE (134)..(134): Xaa at position 134 is Met, Ile, Leu, Val, Ala, or Gly
  SITE (135)..(135): Xaa at position 135 is Ile, Ala, Val, Leu, or Gly
  SITE (136)..(136): Xaa at position 136 is Cys, Ala, Val, Gly, Ser, or Thr
  SITE (137)..(137): Xaa at position 137 is Ala, Gly, or Pro
  SITE (139)..(139): Xaa at position 139 is Leu, Ala, Val, Gly, or Ile
  SITE (148)..(148): Xaa at position 148 is Ala, Gly, or Pro
  SITE (151)..(151): Xaa at position 151 is Ala, Gly, or Pro
  SITE (155)..(155): Xaa at position 155 is Tyr, Phe, Met, His, Ile, Leu, Val Ala, or Gly
  SITE (174)..(174): Xaa at position 174 is Tyr, Phe, Met, His, Ile, Leu, Val Ala, or Gly
  SITE (175)..(175): Xaa at position 175 is Val, Ala, Gly, Leu, or Ile
  SITE (180)..(180): Xaa at position 180 is Tyr, Phe, Met, His, Ile, Leu, Val Ala, or Gly
  SITE (193)..(193): Xaa at position 193 is Leu, Ala, Val, Gly, or Ile
  SITE (195)..(195): Xaa at position 195 is Phe, Tyr, Met, His, Ile, Leu, Val Ala, or Gly
  SITE (198)..(198): Xaa at position 198 is Met, Ile, Leu, Val, Ala, or Gly
  SITE (200)..(200): Xaa at position 200 is Phe, Tyr, Met, His, Ile, Leu, Val Ala, or Gly
  SITE (206)..(206): Xaa at position 206 is Phe, Tyr, Met, His, Ile, Leu, Val Ala, or Gly
  SITE (217)..(217): Xaa at position 217 is Val, Ala, Gly, Leu, or Ile
  SITE (241)..(241): Xaa at position 241 is Phe, Tyr, Met, His, Ile, Leu, Val Ala, or Gly
  SITE (249)..(249): Xaa at position 249 is Val, Ala, Gly, Leu, or Ile
  SITE (255)..(255): Xaa at position 255 is Val, Ala, Gly, Leu, or Ile
  SITE (257)..(257): Xaa at position 257 is Phe, Tyr, Met, His, Ile, Leu, Val Ala, or Gly
  SITE (259)..(259): Xaa at position 259 is His, Phe, Tyr, Lys, Arg, Gly, Ser Thr, Ala, Val, Leu, Ile, Asn, Met, or Gln
  SITE (270)..(270): Xaa at position 270 is Met, Ile, Leu, Val, Ala, or Gly
  SITE (271)..(271): Xaa at position 271 is Phe, Tyr, Met, His, Ile, Leu, Val Ala, or Gly
  SITE (273)..(273): Xaa at position 273 is Phe, Tyr, Met, His, Ile, Leu, Val Ala, or Gly
  SITE (275)..(275): Xaa at position 275 is Val, Ala, Gly, Leu, or Ile
  SITE (279)..(279): Xaa at position 279 is Phe, Tyr, Met, His, Ile, Leu, Val Ala, or Gly
  SITE (317)..(317): Xaa at position 317 is Val, Ala, Gly, Leu, or Ile
  SITE (325)..(325): Xaa at position 325 is Leu, Ala, Val, Gly, or Ile
  SITE (328)..(328): Xaa at position 328 is Ala, Gly, or Pro
  SITE (341)..(341): Xaa at position 341 is Phe, Tyr, Met, His, Ile, Leu, Val Ala, or Gly
  SITE (343)..(343): Xaa at position 343 is Val, Ala, Gly, Leu, or Ile
MTAIIKEIVSRNKRRYQEDGFDLDXTYIYPNIXXXGFPXERLEGVYRNNXDDXVRXXDSKHKNHYKXXNXCAERHYDTAKFNCRVAQYPFEDHNPPQLELXKPXXEDXDQWLSEDDNHVXXXXCKXGKGRTGXXXXXYXLHRGKFLKXQEXLDFXGEVRTRDKKGVTIPSQRRXXYYYSXLLKNHLDYRPVAXLXHKXMXETIPMXSGGTCNPQFVXCQLKVKIYSSNSGPTRREDKFMYXEFPQPLPXCGDIKXEXFXKQNKMLKKDKXXHXWXNTFXIPGPEETSEKVENGSLCDQEIDSICSIERADNDKEYLXLTLTKNDXDKXNKDKANRYFSPNXKXKLYFTKTVEEPSNPEASSSTSVTPDVSDNEPDHYRYSDTTDSDPENEPFDEDQHTQITKV

SEQ ID NO: 587 - protein, 153 aa, Homo sapiens
  SITE (34)..(34): Xaa at position 34 is Leu, Ala, Val, Gly, or Ile
  SITE (37)..(37): Xaa at position 37 is Leu, Ala, Val, Gly, or Ile
  SITE (38)..(38): Xaa at position 38 is Leu, Ala, Val, Gly, or Ile
  SITE (41)..(41): Xaa at position 41 is Leu, Ala, Val, Gly, or Ile
  SITE (44)..(44): Xaa at position 44 is Ile, Ala, Val, Leu, or Gly
  SITE (45)..(45): Xaa at position 45 is Leu, Ala, Val, Gly, or Ile
  SITE (48)..(48): Xaa at position 48 is Ile, Ala, Val, Leu, or Gly
  SITE (59)..(59): Xaa at position 59 is Met, Ile, Leu, Val, Ala, or Gly
  SITE (62)..(62): Xaa at position 62 is Phe, Tyr, Met, His, Ile, Leu, Val Ala, or Gly
  SITE (64)..(64): Xaa at position 64 is Phe, Tyr, Met, His, Ile, Leu, Val Ala, or Gly
  SITE (66)..(66): Xaa at position 66 is Met, Ile, Leu, Val, Ala, or Gly
  SITE (73)..(73): Xaa at position 73 is Leu, Ala, Val, Gly, or Ile
  SITE (75)..(75): Xaa at position 75 is His, Phe, Tyr, Lys, Arg, Gly, Ser Thr, Ala, Val, Leu, Ile, Asn, Met, or Gln
  SITE (76)..(76): Xaa at position 76 is Leu, Ala, Val, Gly, or Ile
  SITE (78)..(78): Xaa at position 78 is Cys, Ala, Val, Gly, Ser, or Thr
  SITE (79)..(79): Xaa at position 79 is Leu, Ala, Val, Gly, or Ile
  SITE (83)..(83): Xaa at position 83 is Leu, Ala, Val, Gly, or Ile
  SITE (86)..(86): Xaa at position 86 is Leu, Ala, Val, Gly, or Ile
  SITE (89)..(89): Xaa at position 89 is Val, Ala, Gly, Leu, or Ile
  SITE (90)..(90): Xaa at position 90 is Leu, Ala, Val, Gly, or Ile
  SITE (98)..(98): Xaa at position 98 is Phe, Tyr, Met, His, Ile, Leu, Val Ala, or Gly
  SITE (105)..(105): Xaa at position 105 is Leu, Ala, Val, Gly, or Ile
  SITE (106)..(106): Xaa at position 106 is Ile, Ala, Val, Leu, or Gly
  SITE (109)..(109): Xaa at position 109 is Ile, Ala, Val, Leu, or Gly
  SITE (112)..(112): Xaa at position 112 is Ile, Ala, Val, Leu, or Gly
  SITE (113)..(113): Xaa at position 113 is Val, Ala, Gly, Leu, or Ile
  SITE (123)..(123): Xaa at position 123 is Phe, Tyr, Met, His, Ile, Leu, Val Ala, or Gly
  SITE (134)..(134): Xaa at position 134 is Ile, Ala, Val, Leu, or Gly
  SITE (135)..(135): Xaa at position 135 is Val, Ala, Gly, Leu, or Ile
  SITE (137)..(137): Xaa at position 137 is Phe, Tyr, Met, His, Ile, Leu, Val Ala, or Gly
  SITE (138)..(138): Xaa at position 138 is Leu, Ala, Val, Gly, or Ile
  SITE (141)..(141): Xaa at position 141 is Trp, Tyr, Phe, Met, His, Ile, Leu Val, Ala, or Gly
  SITE (144)..(144): Xaa at position 144 is Phe, Tyr, Met, His, Ile, Leu, Val Ala, or Gly
  SITE (145)..(145): Xaa at position 145 is Cys, Ala, Val, Gly, Ser, or Thr
  SITE (148)..(148): Xaa at position 148 is Ile, Ala, Val, Leu, or Gly
MYRMQLLSCIALSLALVTNSAPTSSSTKKTQLQXEHXXLDXQMXXNGXNNYKNPKLTRXLTXKXYXPKKATEXKXXQXXEEEXKPXEEXXNLAQSKNXHLRPRDXXSNXNVXXLELKGSETTXMCEYADETATXXEXXNRXITXXQSXISTLT

SEQ ID NO: 588 - protein, 246 aa, Homo sapiens
  SITE (31)..(31): Xaa at position 31 is Ala, Gly, or Pro
  SITE (40)..(40): Xaa at position 40 is Val, Ala, Gly, Leu, or Ile
  SITE (41)..(41): Xaa at position 41 is Ala, Gly, or Pro
  SITE (42)..(42): Xaa at position 42 is Val, Ala, Gly, Leu, or Ile
  SITE (47)..(47): Xaa at position 47 is Cys, Ala, Val, Gly, Ser, or Thr
  SITE (48)..(48): Xaa at position 48 is Ala, Gly, or Pro
  SITE (49)..(49): Xaa at position 49 is Val, Ala, Gly, Leu, or Ile
  SITE (50)..(50): Xaa at position 50 is Ile, Ala, Val, Leu, or Gly
  SITE (51)..(51): Xaa at position 51 is Val, Ala, Gly, Leu, or Ile
  SITE (78)..(78): Xaa at position 78 is Cys, Ala, Val, Gly, Ser, or Thr
  SITE (79)..(79): Xaa at position 79 is Val, Ala, Gly, Leu, or Ile
  SITE (91)..(91): Xaa at position 91 is Val, Ala, Gly, Leu, or Ile
  SITE (94)..(94): Xaa at position 94 is Ala, Gly, or Pro
  SITE (96)..(96): Xaa at position 96 is Tyr, Phe, Met, His, Ile, Leu, Val Ala, or Gly
  SITE (99)..(99): Xaa at position 99 is Ala, Gly, or Pro
  SITE (114)..(114): Xaa at position 114 is Leu, Ala, Val, Gly, or Ile
  SITE (115)..(115): Xaa at position 115 is Cys, Ala, Val, Gly, Ser, or Thr
  SITE (118)..(118): Xaa at position 118 is Ile, Ala, Val, Leu, or Gly
  SITE (119)..(119): Xaa at position 119 is Ala, Gly, or Pro
  SITE (136)..(136): Xaa at position 136 is Cys, Ala, Val, Gly, Ser, or Thr
  SITE (138)..(138): Xaa at position 138 is Met, Ile, Leu, Val, Ala, or Gly
  SITE (139)..(139): Xaa at position 139 is Ile, Ala, Val, Leu, or Gly
  SITE (140)..(140): Xaa at position 140 is Leu, Ala, Val, Gly, or Ile
  SITE (141)..(141): Xaa at position 141 is Ile, Ala, Val, Leu, or Gly
  SITE (151)..(151): Xaa at position 151 is Val, Ala, Gly, Leu, or Ile
  SITE (154)..(154): Xaa at position 154 is Cys, Ala, Val, Gly, Ser, or Thr
  SITE (165)..(165): Xaa at position 165 is Ala, Gly, or Pro
  SITE (167)..(167): Xaa at position 167 is Ala, Gly, or Pro
  SITE (168)..(168): Xaa at position 168 is Ala, Gly, or Pro
  SITE (195)..(195): Xaa at position 195 is Val, Ala, Gly, Leu, or Ile
  SITE (198)..(198): Xaa at position 198 is Ala, Gly, or Pro
  SITE (199)..(199): Xaa at position 199 is Ile, Ala, Val, Leu, or Gly
  SITE (201)..(201): Xaa at position 201 is Cys, Ala, Val, Gly, Ser, or Thr
  SITE (202)..(202): Xaa at position 202 is Leu, Ala, Val, Gly, or Ile
  SITE (217)..(217): Xaa at position 217 is Val, Ala, Gly, Leu, or Ile
  SITE (219)..(219): Xaa at position 219 is Val, Ala, Gly, Leu, or Ile
  SITE (220)..(220): Xaa at position 220 is Val, Ala, Gly, Leu, or Ile
MSRGSSAGFDRHITIFSPEGRLYQVEYAFKXINQGGLTSXXXRGKDXXXXXTQKKVPDKLLDSSTVTHLFKITENIGXXMTGMTADSRSQXQRXRXEAXNWKYKYGYEIPVDMXXKRXXDISQVYTQNAEMRPLGXCXXXXGIDEEQGPQXYKXDPAGYYCGFKXTXXGVKQTESTSFLEKKVKKKFDWTFEQTXETXXTXXSTVLSIDFKPSEIEXGXXTVENPKFRILTEAEIDAHLVALAERD

SEQ ID NO: 589 - protein, 191 aa, Homo sapiens
  SITE (4)..(4): Xaa at position 4 is Ile, Ala, Val, Leu, or Gly
  SITE (6)..(6): Xaa at position 6 is Cys, Ala, Val, Gly, Ser, or Thr
  SITE (7)..(7): Xaa at position 7 is Val, Ala, Gly, Leu, or Ile
  SITE (8)..(8): Xaa at position 8 is Val, Ala, Gly, Leu, or Ile
  SITE (9)..(9): Xaa at position 9 is Val, Ala, Gly, Leu, or Ile
  SITE (13)..(13): Xaa at position 13 is Ala, Gly, or Pro
  SITE (14)..(14): Xaa at position 14 is Val, Ala, Gly, Leu, or Ile
  SITE (18)..(18): Xaa at position 18 is Cys, Ala, Val, Gly, Ser, or Thr
  SITE (19)..(19): Xaa at position 19 is Leu, Ala, Val, Gly, or Ile
  SITE (20)..(20): Xaa at position 20 is Leu, Ala, Val, Gly, or Ile
  SITE (28)..(28): Xaa at position 28 is Phe, Tyr, Met, His, Ile, Leu, Val Ala, or Gly
  SITE (36)..(36): Xaa at position 36 is Val, Ala, Gly, Leu, or Ile
  SITE (37)..(37): Xaa at position 37 is Phe, Tyr, Met, His, Ile, Leu, Val Ala, or Gly
  SITE (42)..(42): Xaa at position 42 is Val, Ala, Gly, Leu, or Ile
  SITE (44)..(44): Xaa at position 44 is Val, Ala, Gly, Leu, or Ile
  SITE (46)..(46): Xaa at position 46 is Ile, Ala, Val, Leu, or Gly
  SITE (51)..(51): Xaa at position 51 is Tyr, Phe, Met, His, Ile, Leu, Val Ala, or Gly
  SITE (53)..(53): Xaa at position 53 is Leu, Ala, Val, Gly, or Ile
  SITE (55)..(55): Xaa at position 55 is Leu, Ala, Val, Gly, or Ile
  SITE (59)..(59): Xaa at position 59 is Ala, Gly, or Pro
  SITE (70)..(70): Xaa at position 70 is Leu, Ala, Val, Gly, or Ile
  SITE (72)..(72): Xaa at position 72 is Tyr, Phe, Met, His, Ile, Leu, Val Ala, or Gly
  SITE (77)..(77): Xaa at position 77 is Val, Ala, Gly, Leu, or Ile
  SITE (78)..(78): Xaa at position 78 is Phe, Tyr, Met, His, Ile, Leu, Val Ala, or Gly
  SITE (79)..(79): Xaa at position 79 is Leu, Ala, Val, Gly, or Ile
  SITE (80)..(80): Xaa at position 80 is Val, Ala, Gly, Leu, or Ile
  SITE (81)..(81): Xaa at position 81 is Cys, Ala, Val, Gly, Ser, or Thr
  SITE (82)..(82): Xaa at position 82 is Phe, Tyr, Met, His, Ile, Leu, Val Ala, or Gly
  SITE (84)..(84): Xaa at position 84 is Val, Ala, Gly, Leu, or Ile
  SITE (85)..(85): Xaa at position 85 is Val, Ala, Gly, Leu, or Ile
  SITE (90)..(90): Xaa at position 90 is Phe, Tyr, Met, His, Ile, Leu, Val Ala, or Gly
  SITE (93)..(93): Xaa at position 93 is Val, Ala, Gly, Leu, or Ile
  SITE (97)..(97): Xaa at position 97 is Trp, Tyr, Phe, Met, His, Ile, Leu Val, Ala, or Gly
  SITE (98)..(98): Xaa at position 98 is Val, Ala, Gly, Leu, or Ile
  SITE (101)..(101): Xaa at position 101 is Ile, Ala, Val, Leu, or Gly
  SITE (105)..(105): Xaa at position 105 is Cys, Ala, Val, Gly, Ser, or Thr
  SITE (110)..(110): Xaa at position 110 is Phe, Tyr, Met, His, Ile, Leu, Val Ala, or Gly
  SITE (111)..(111): Xaa at position 111 is Leu, Ala, Val, Gly, or Ile
  SITE (112)..(112): Xaa at position 112 is Leu, Ala, Val, Gly, or Ile
  SITE (113)..(113): Xaa at position 113 is Val, Ala, Gly, Leu, or Ile
  SITE (117)..(117): Xaa at position 117 is Ile, Ala, Val, Leu, or Gly
  SITE (129)..(129): Xaa at position 129 is Leu, Ala, Val, Gly, or Ile
  SITE (137)..(137): Xaa at position 137 is Ile, Ala, Val, Leu, or Gly
  SITE (142)..(142): Xaa at position 142 is Ala, Gly, or Pro
  SITE (145)..(145): Xaa at position 145 is Leu, Ala, Val, Gly, or Ile
  SITE (146)..(146): Xaa at position 146 is Ala, Gly, or Pro
  SITE (149)..(149): Xaa at position 149 is Leu, Ala, Val, Gly, or Ile
  SITE (155)..(155): Xaa at position 155 is Val, Ala, Gly, Leu, or Ile
  SITE (157)..(157): Xaa at position 157 is Cys, Ala, Val, Gly, Ser, or Thr
  SITE (159)..(159): Xaa at position 159 is Ala, Gly, or Pro
  SITE (165)..(165): Xaa at position 165 is Leu, Ala, Val, Gly, or Ile
  SITE (168)..(168): Xaa at position 168 is Val, Ala, Gly, Leu, or Ile
  SITE (169)..(169): Xaa at position 169 is Phe, Tyr, Met, His, Ile, Leu, Val Ala, or Gly
  SITE (172)..(172): Xaa at position 172 is Ala, Gly, or Pro
  SITE (173)..(173): Xaa at position 173 is Ile, Ala, Val, Leu, or Gly
  SITE (175)..(175): Xaa at position 175 is Ala, Gly, or Pro
  SITE (176)..(176): Xaa at position 176 is Ala, Gly, or Pro
MQTXKXXXXGDGXXGKTXXXISYTTNKXPSEYVPTXXDNYAXTXMXGGEPXTXGXFDTXGQEDYDRLRPXSXPQTDXXXXXXSXXSPSSXENXKEKXXPEXTHHXPKTPXXXXGTQXDLRDDPSTIEKXAKNKQKPXTPETXEKXXRDXKAVKYXEXSXLTQKGXKNXXDEXXLXXLEPPEPKKSRRCVLL

SEQ ID NO: 590 - protein, 104 aa, Homo sapiens
  SITE (17)..(17): Xaa at position 17 is Leu, Ala, Val, Gly, or Ile
  SITE (25)..(25): Xaa at position 25 is Trp, Tyr, Phe, Met, His, Ile, Leu Val, Ala, or Gly
  SITE (33)..(33): Xaa at position 33 is Ala, Gly, or Pro
  SITE (34)..(34): Xaa at position 34 is Ile, Ala, Val, Leu, or Gly
  SITE (40)..(40): Xaa at position 40 is Phe, Tyr, Met, His, Ile, Leu, Val Ala, or Gly
  SITE (46)..(46): Xaa at position 46 is Ala, Gly, or Pro
  SITE (49)..(49): Xaa at position 49 is Phe, Tyr, Met, His, Ile, Leu, Val Ala, or Gly
  SITE (53)..(53): Xaa at position 53 is Val, Ala, Gly, Leu, or Ile
  SITE (57)..(57): Xaa at position 57 is Ala, Gly, or Pro
  SITE (73)..(73): Xaa at position 73 is Val, Ala, Gly, Leu, or Ile
  SITE (75)..(75): Xaa at position 75 is Ile, Ala, Val, Leu, or Gly
  SITE (77)..(77): Xaa at position 77 is Leu, Ala, Val, Gly, or Ile
  SITE (85)..(85): Xaa at position 85 is Leu, Ala, Val, Gly, or Ile
  SITE (92)..(92): Xaa at position 92 is Leu, Ala, Val, Gly, or Ile
  SITE (93)..(93): Xaa at position 93 is Ala, Gly, or Pro
  SITE (96)..(96): Xaa at position 96 is Ile, Ala, Val, Leu, or Gly
  SITE (99)..(99): Xaa at position 99 is Val, Ala, Gly, Leu, or Ile
MAGKAHRLSAEERDQLXPNLRAVGXNELEGRDXXFKQFHXKDFNRXFGXMTRXALQXEKLDHHPEWFNVYNKXHXTXSTHECAGXSERDINXXSFXEQXAVSMT

SEQ ID NO: 591 - protein, 148 aa, Homo sapiens
  SITE (24)..(24): Xaa at position 24 is Cys, Ala, Val, Gly, Ser, or Thr
  SITE (26)..(26): Xaa at position 26 is Leu, Ala, Val, Gly, or Ile
  SITE (27)..(27): Xaa at position 27 is Ala, Gly, or Pro
  SITE (30)..(30): Xaa at position 30 is Leu, Ala, Val, Gly, or Ile
  SITE (35)..(35): Xaa at position 35 is Met, Ile, Leu, Val, Ala, or Gly
  SITE (43)..(43): Xaa at position 43 is Leu, Ala, Val, Gly, or Ile
  SITE (44)..(44): Xaa at position 44 is Ala, Gly, or Pro
  SITE (46)..(46): Xaa at position 46 is Trp, Tyr, Phe, Met, His, Ile, Leu Val, Ala, or Gly
  SITE (47)..(47): Xaa at position 47 is Met, Ile, Leu, Val, Ala, or Gly
  SITE (48)..(48): Xaa at position 48 is Cys, Ala, Val, Gly, Ser, or Thr
  SITE (49)..(49): Xaa at position 49 is Leu, Ala, Val, Gly, or Ile
  SITE (50)..(50): Xaa at position 50 is Ala, Gly, or Pro
  SITE (74)..(74): Xaa at position 74 is Ile, Ala, Val, Leu, or Gly
  SITE (75)..(75): Xaa at position 75 is Phe, Tyr, Met, His, Ile, Leu, Val Ala, or Gly
  SITE (77)..(77): Xaa at position 77 is Ile, Ala, Val, Leu, or Gly
  SITE (83)..(83): Xaa at position 83 is Cys, Ala, Val, Gly, Ser, or Thr
  SITE (95)..(95): Xaa at position 95 is Cys, Ala, Val, Gly, Ser, or Thr
  SITE (99)..(99): Xaa at position 99 is Cys, Ala, Val, Gly, Ser, or Thr
  SITE (102)..(102): Xaa at position 102 is Leu, Ala, Val, Gly, or Ile
  SITE (107)..(107): Xaa at position 107 is Ile, Ala, Val, Leu, or Gly
  SITE (108)..(108): Xaa at position 108 is Ala, Gly, or Pro
  SITE (110)..(110): Xaa at position 110 is Ala, Gly, or Pro
  SITE (111)..(111): Xaa at position 111 is Val, Ala, Gly, Leu, or Ile
  SITE (113)..(113): Xaa at position 113 is Cys, Ala, Val, Gly, Ser, or Thr
  SITE (114)..(114): Xaa at position 114 is Ala, Gly, or Pro
  SITE (117)..(117): Xaa at position 117 is Val, Ala, Gly, Leu, or Ile
  SITE (118)..(118): Xaa at position 118 is Val, Ala, Gly, Leu, or Ile
  SITE (124)..(124): Xaa at position 124 is Ile, Ala, Val, Leu, or Gly
  SITE (127)..(127): Xaa at position 127 is Trp, Tyr, Phe, Met, His, Ile, Leu Val, Ala, or Gly
  SITE (134)..(134): Xaa at position 134 is Cys, Ala, Val, Gly, Ser, or Thr
  SITE (139)..(139): Xaa at position 139 is Val, Ala, Gly, Leu, or Ile
  SITE (146)..(146): Xaa at position 146 is Cys, Ala, Val, Gly, Ser, or Thr
MKALIVLGLVLLSVTVQGKVFERXEXXRTXKRLGXDGYRGISXXNXXXXXKWESGYNTRATNYNAGDRSTDYGXXQXNSRYWXNDGKTPGAVNAXHLSXSAXLQDNXXDXXAXXKRXXRDPQGXRAXVAWRNRXQNRDXRQYVQGXGV

SEQ ID NO: 592 - protein, 119 aa, Homo sapiens
  SITE (29)..(29): Xaa at position 29 is Val, Ala, Gly, Leu, or Ile
  SITE (30)..(30): Xaa at position 30 is Tyr, Phe, Met, His, Ile, Leu, Val Ala, or Gly
  SITE (43)..(43): Xaa at position 43 is Leu, Ala, Val, Gly, or Ile
  SITE (45)..(45): Xaa at position 45 is Cys, Ala, Val, Gly, Ser, or Thr
  SITE (47)..(47): Xaa at position 47 is Val, Ala, Gly, Leu, or Ile
  SITE (50)..(50): Xaa at position 50 is Phe, Tyr, Met, His, Ile, Leu, Val Ala, or Gly
  SITE (51)..(51): Xaa at position 51 is His, Phe, Tyr, Lys, Arg, Gly, Ser Thr, Ala, Val, Leu, Ile, Asn, Met, or Gln
  SITE (59)..(59): Xaa at position 59 is Leu, Ala, Val, Gly, or Ile
  SITE (60)..(60): Xaa at position 60 is Leu, Ala, Val, Gly, or Ile
  SITE (82)..(82): Xaa at position 82 is Phe, Tyr, Met, His, Ile, Leu, Val Ala, or Gly
  SITE (84)..(84): Xaa at position 84 is Leu, Ala, Val, Gly, or Ile
  SITE (86)..(86): Xaa at position 86 is Tyr, Phe, Met, His, Ile, Leu, Val Ala, or Gly
  SITE (90)..(90): Xaa at position 90 is Phe, Tyr, Met, His, Ile, Leu, Val Ala, or Gly
  SITE (98)..(98): Xaa at position 98 is Tyr, Phe, Met, His, Ile, Leu, Val Ala, or Gly
  SITE (99)..(99): Xaa at position 99 is Ala, Gly, or Pro
  SITE (100)..(100): Xaa at position 100 is Cys, Ala, Val, Gly, Ser, or Thr
  SITE (102)..(102): Xaa at position 102 is Val, Ala, Gly, Leu, or Ile
  SITE (104)..(104): Xaa at position 104 is His, Phe, Tyr, Lys, Arg, Gly, Ser Thr, Ala, Val, Leu, Ile, Asn, Met, or Gln
  SITE (115)..(115): Xaa at position 115 is Trp, Tyr, Phe, Met, His, Ile, Leu Val, Ala, or Gly
MSRSVALAVLALLSLSGLEAIQRTPKIQXXSRHPAENGKSNFXNXYXSGXXPSDIEVDXXKNGERIEKVEHSDLSFSKDWSXYXLXYTEXTPTEKDEXXXRXNXVTLSQPKIVKXDRDM

SEQ ID NO: 593 - protein, 414 aa, Homo sapiens
  SITE (317)..(317): Xaa at position 317 is Cys, Ala, Val, Gly, Ser, or Thr
  SITE (318)..(318): Xaa at position 318 is Cys, Ala, Val, Gly, Ser, or Thr
  SITE (319)..(319): Xaa at position 319 is Leu, Ala, Val, Gly, or Ile
  SITE (326)..(326): Xaa at position 326 is Phe, Tyr, Met, His, Ile, Leu, Val Ala, or Gly
  SITE (350)..(350): Xaa at position 350 is Cys, Ala, Val, Gly, Ser, or Thr
  SITE (388)..(388): Xaa at position 388 is Leu, Ala, Val, Gly, or Ile
  SITE (390)..(390): Xaa at position 390 is Ile, Ala, Val, Leu, or Gly
  SITE (413)..(413): Xaa at position 413 is Cys, Ala, Val, Gly, Ser, or Thr
MHYCVLSAFLILHLVTVALSLSTCSTLDMDQFMRKRIEAIRGQILSKLKLTSPPEDYPEPEEVPPEVISIYNSTRDLLQEKASRRAAACERERSDEEYYAKEVYKIDMPPFFPSENAIPPTFYRPYFRIVRFDVSAMEKNASNLVKAEFRVFRLQNPKARVPEQRIELYQILKSKDLTSPTQRYIDSKVVKTRAEGEWLSFDVTDAVHEWLHHKDRNLGFKISLHCPCCTFVPSNNYIIPNKSEELEARFAGIDGTSTYTSGDQKTIKSTRKKNSGKTPHLLLMLLPSYRLESQQTNRRKKRALDAAYCFRNVQDNXXXRPLYIDXKRDLGWKWIHEPKGYNANFCAGAXPYLWSSDTQHSRVLSLYNTINPEASASPCCVSQDLEPXTXLYYIGKTPKIEQLSNMIVKSCKXS

SEQ ID NO: 594 - protein, 151 aa, Homo sapiens
  SITE (37)..(37): Xaa at position 37 is Val, Ala, Gly, Leu, or Ile
  SITE (42)..(42): Xaa at position 42 is Cys, Ala, Val, Gly, Ser, or Thr
  SITE (47)..(47): Xaa at position 47 is Cys, Ala, Val, Gly, Ser, or Thr
  SITE (55)..(55): Xaa at position 55 is Tyr, Phe, Met, His, Ile, Leu, Val Ala, or Gly
  SITE (59)..(59): Xaa at position 59 is Val, Ala, Gly, Leu, or Ile
  SITE (61)..(61): Xaa at position 61 is Phe, Tyr, Met, His, Ile, Leu, Val Ala, or Gly
  SITE (101)..(101): Xaa at position 101 is Ile, Ala, Val, Leu, or Gly
  SITE (109)..(109): Xaa at position 109 is Tyr, Phe, Met, His, Ile, Leu, Val Ala, or Gly
  SITE (124)..(124): Xaa at position 124 is Leu, Ala, Val, Gly, or Ile
  SITE (128)..(128): Xaa at position 128 is Trp, Tyr, Phe, Met, His, Ile, Leu Val, Ala, or Gly
  SITE (130)..(130): Xaa at position 130 is Leu, Ala, Val, Gly, or Ile
  SITE (138)..(138): Xaa at position 138 is Leu, Ala, Val, Gly, or Ile
  SITE (139)..(139): Xaa at position 139 is Phe, Tyr, Met, His, Ile, Leu, Val Ala, or Gly
  SITE (140)..(140): Xaa at position 140 is Cys, Ala, Val, Gly, Ser, or Thr
  SITE (141)..(141): Xaa at position 141 is Trp, Tyr, Phe, Met, His, Ile, Leu Val, Ala, or Gly
MRFLAATFLLLALSTAAQAEPVQFKDCGSVDGVIKEXNVSPXPTQPXQLSKGQSXSVNXTXTSNIQSKSSKAVVHGILMGVPVPFPIPEPDGCKSGINCPXQKDKTYSXLNKLPVKSEYPSIKXVVEXQXQDDKNQSXXXXEIPVQIVSHL

SEQ ID NO: 595 - protein, 204 aa, Homo sapiens
  SITE (15)..(15): Xaa at position 15 is Tyr, Phe, Met, His, Ile, Leu, Val Ala, or Gly
  SITE (17)..(17): Xaa at position 17 is Leu, Ala, Val, Gly, or Ile
  SITE (18)..(18): Xaa at position 18 is Val, Ala, Gly, Leu, or Ile
  SITE (19)..(19): Xaa at position 19 is Val, Ala, Gly, Leu, or Ile
  SITE (20)..(20): Xaa at position 20 is Val, Ala, Gly, Leu, or Ile
  SITE (25)..(25): Xaa at position 25 is Val, Ala, Gly, Leu, or Ile
  SITE (30)..(30): Xaa at position 30 is Leu, Ala, Val, Gly, or Ile
  SITE (34)..(34): Xaa at position 34 is Phe, Tyr, Met, His, Ile, Leu, Val Ala, or Gly
  SITE (40)..(40): Xaa at position 40 is Val, Ala, Gly, Leu, or Ile
  SITE (55)..(55): Xaa at position 55 is Cys, Ala, Val, Gly, Ser, or Thr
  SITE (57)..(57): Xaa at position 57 is Ile, Ala, Val, Leu, or Gly
  SITE (62)..(62): Xaa at position 62 is Ala, Gly, or Pro
  SITE (64)..(64): Xaa at position 64 is Leu, Ala, Val, Gly, or Ile
  SITE (66)..(66): Xaa at position 66 is Ile, Ala, Val, Leu, or Gly
  SITE (67)..(67): Xaa at position 67 is Leu, Ala, Val, Gly, or Ile
  SITE (70)..(70): Xaa at position 70 is Ala, Gly, or Pro
  SITE (78)..(78): Xaa at position 78 is Met, Ile, Leu, Val, Ala, or Gly
  SITE (83)..(83): Xaa at position 83 is Met, Ile, Leu, Val, Ala, or Gly
  SITE (89)..(89): Xaa at position 89 is Phe, Tyr, Met, His, Ile, Leu, Val Ala, or Gly
  SITE (90)..(90): Xaa at position 90 is Leu, Ala, Val, Gly, or Ile
  SITE (91)..(91): Xaa at position 91 is Leu, Ala, Val, Gly, or Ile
  SITE (92)..(92): Xaa at position 92 is Val, Ala, Gly, Leu, or Ile
  SITE (93)..(93): Xaa at position 93 is Phe, Tyr, Met, His, Ile, Leu, Val Ala, or Gly
  SITE (95)..(95): Xaa at position 95 is Val, Ala, Gly, Leu, or Ile
  SITE (101)..(101): Xaa at position 101 is Phe, Tyr, Met, His, Ile, Leu, Val Ala, or Gly
  SITE (104)..(104): Xaa at position 104 is Ile, Ala, Val, Leu, or Gly
  SITE (107)..(107): Xaa at position 107 is Phe, Tyr, Met, His, Ile, Leu, Val Ala, or Gly
  SITE (111)..(111): Xaa at position 111 is Ile, Ala, Val, Leu, or Gly
  SITE (114)..(114): Xaa at position 114 is Val, Ala, Gly, Leu, or Ile
  SITE (120)..(120): Xaa at position 120 is Phe, Tyr, Met, His, Ile, Leu, Val Ala, or Gly
  SITE (122)..(122): Xaa at position 122 is Met, Ile, Leu, Val, Ala, or Gly
  SITE (123)..(123): Xaa at position 123 is Ile, Ala, Val, Leu, or Gly
  SITE (124)..(124): Xaa at position 124 is Leu, Ala, Val, Gly, or Ile
  SITE (125)..(125): Xaa at position 125 is Ile, Ala, Val, Leu, or Gly
  SITE (131)..(131): Xaa at position 131 is Leu, Ala, Val, Gly, or Ile
  SITE (137)..(137): Xaa at position 137 is Val, Ala, Gly, Leu, or Ile
  SITE (145)..(145): Xaa at position 145 is Leu, Ala, Val, Gly, or Ile
  SITE (146)..(146): Xaa at position 146 is Ala, Gly, or Pro
  SITE (156)..(156): Xaa at position 156 is Ala, Gly, or Pro
  SITE (158)..(158): Xaa at position 158 is Ala, Gly, or Pro
  SITE (164)..(164): Xaa at position 164 is Val, Ala, Gly, Leu, or Ile
  SITE (167)..(167): Xaa at position 167 is Ala, Gly, or Pro
  SITE (168)..(168): Xaa at position 168 is Phe, Tyr, Met, His, Ile, Leu, Val Ala, or Gly
  SITE (171)..(171): Xaa at position 171 is Leu, Ala, Val, Gly, or Ile
  SITE (172)..(172): Xaa at position 172 is Val, Ala, Gly, Leu, or Ile
MAAAGWRDGSGQEKXRXXXXGGGGXGKSAXTIQXIQSYFXTDYDPTIEDSYTKQXVXDDRAXRXDXXDTXGQEEFGAXREQYXRTGEGXXXXXSXTDRGSXEEXYKXQRQXLRXKDRDEXPXXXXGNKADXDHQRQXTQEEGQQXXRQLKVTYMEXSXKIRMNXDQXXHEXXRVIRKFQEQECPPSPEPTRKEKDKKGCHCVIF

SEQ ID NO: 596 - protein, 194 aa, Homo sapiens
  SITE (27)..(27): Xaa at position 27 is Leu, Ala, Val, Gly, or Ile
  SITE (30)..(30): Xaa at position 30 is Leu, Ala, Val, Gly, or Ile
  SITE (36)..(36): Xaa at position 36 is Leu, Ala, Val, Gly, or Ile
  SITE (40)..(40): Xaa at position 40 is Leu, Ala, Val, Gly, or Ile
  SITE (43)..(43): Xaa at position 43 is Leu, Ala, Val, Gly, or Ile
  SITE (51)..(51): Xaa at position 51 is Ile, Ala, Val, Leu, or Gly
  SITE (59)..(59): Xaa at position 59 is Ala, Gly, or Pro
  SITE (61)..(61): Xaa at position 61 is Ile, Ala, Val, Leu, or Gly
  SITE (64)..(64): Xaa at position 64 is Val, Ala, Gly, Leu, or Ile
  SITE (72)..(72): Xaa at position 72 is Phe, Tyr, Met, His, Ile, Leu, Val Ala, or Gly
  SITE (79)..(79): Xaa at position 79 is Leu, Ala, Val, Gly, or Ile
  SITE (93)..(93): Xaa at position 93 is Val, Ala, Gly, Leu, or Ile
  SITE (95)..(95): Xaa at position 95 is Ile, Ala, Val, Leu, or Gly
  SITE (130)..(130): Xaa at position 130 is Leu, Ala, Val, Gly, or Ile
  SITE (133)..(133): Xaa at position 133 is Leu, Ala, Val, Gly, or Ile
  SITE (134)..(134): Xaa at position 134 is Val, Ala, Gly, Leu, or Ile
  SITE (156)..(156): Xaa at position 156 is Val, Ala, Gly, Leu, or Ile
  SITE (173)..(173): Xaa at position 173 is Phe, Tyr, Met, His, Ile, Leu, Val Ala, or Gly
  SITE (176)..(176): Xaa at position 176 is Val, Ala, Gly, Leu, or Ile
  SITE (177)..(177): Xaa at position 177 is Tyr, Phe, Met, His, Ile, Leu, Val Ala, or Gly
  SITE (185)..(185): Xaa at position 185 is Val, Ala, Gly, Leu, or Ile
MFSSSAKIVKPNGEKPDEFESGISQAXLEXEMNSDXKAQXREXNITAAKEXEVGGGRKXIXIFXPVPQLKSXQKIQVRXVRELEKKFSGKHVXFXAQRRILPKPTRKSRTKNKQKRPRSRTLTAVHDAIXEDXXFPSEIVGKRIRVKLDGSRLIKXHLDKAQQNNVEHKVETXSGXXKKLTGKDXNFEFPEFQL

SEQ ID NO: 597 - protein, 377 aa, Homo sapiens
  SITE (9)..(9): Xaa at position 9 is Ala, Gly, or Pro
  SITE (10)..(10): Xaa at position 10 is Leu, Ala, Val, Gly, or Ile
  SITE (11)..(11): Xaa at position 11 is Val, Ala, Gly, Leu, or Ile
  SITE (12)..(12): Xaa at position 12 is Cys, Ala, Val, Gly, Ser, or Thr
  SITE (19)..(19): Xaa at position 19 is Cys, Ala, Val, Gly, Ser, or Thr
  SITE (21)..(21): Xaa at position 21 is Ala, Gly, or Pro
  SITE (31)..(31): Xaa at position 31 is Ala, Gly, or Pro
  SITE (32)..(32): Xaa at position 32 is Val, Ala, Gly, Leu, or Ile
  SITE (33)..(33): Xaa at position 33 is Phe, Tyr, Met, His, Ile, Leu, Val Ala, or Gly
  SITE (36)..(36): Xaa at position 36 is Ile, Ala, Val, Leu, or Gly
  SITE (37)..(37): Xaa at position 37 is Val, Ala, Gly, Leu, or Ile
  SITE (55)..(55): Xaa at position 55 is Tyr, Phe, Met, His, Ile, Leu, Val Ala, or Gly
  SITE (60)..(60): Xaa at position 60 is Ala, Gly, or Pro
  SITE (67)..(67): Xaa at position 67 is Leu, Ala, Val, Gly, or Ile
  SITE (73)..(73): Xaa at position 73 is Ile, Ala, Val, Leu, or Gly
  SITE (84)..(84): Xaa at position 84 is Met, Ile, Leu, Val, Ala, or Gly
  SITE (87)..(87): Xaa at position 87 is Ile, Ala, Val, Leu, or Gly
  SITE (88)..(88): Xaa at position 88 is Trp, Tyr, Phe, Met, His, Ile, Leu Val, Ala, or Gly
  SITE (92)..(92): Xaa at position 92 is Phe, Tyr, Met, His, Ile, Leu, Val Ala, or Gly
  SITE (106)..(106): Xaa at position 106 is Leu, Ala, Val, Gly, or Ile
  SITE (107)..(107): Xaa at position 107 is Leu, Ala, Val, Gly, or Ile
  SITE (110)..(110): Xaa at position 110 is Ala, Gly, or Pro
  SITE (112)..(112): Xaa at position 112 is Leu, Ala, Val, Gly, or Ile
  SITE (121)..(121): Xaa at position 121 is Met, Ile, Leu, Val, Ala, or Gly
  SITE (124)..(124): Xaa at position 124 is Ile, Ala, Val, Leu, or Gly
  SITE (125)..(125): Xaa at position 125 is Met, Ile, Leu, Val, Ala, or Gly
  SITE (126)..(126): Xaa at position 126 is Phe, Tyr, Met, His, Ile, Leu, Val Ala, or Gly
  SITE (129)..(129): Xaa at position 129 is Phe, Tyr, Met, His, Ile, Leu, Val Ala, or Gly
  SITE (131)..(131): Xaa at position 131 is Val, Ala, Gly, Leu, or Ile
  SITE (133)..(133): Xaa at position 133 is Ala, Gly, or Pro
  SITE (134)..(134): Xaa at position 134 is Met, Ile, Leu, Val, Ala, or Gly
  SITE (136)..(136): Xaa at position 136 is Val, Ala, Gly, Leu, or Ile
  SITE (140)..(140): Xaa at position 140 is Ala, Gly, or Pro
  SITE (141)..(141): Xaa at position 141 is Val, Ala, Gly, Leu, or Ile
  SITE (142)..(142): Xaa at position 142 is Leu, Ala, Val, Gly, or Ile
  SITE (144)..(144): Xaa at position 144 is Leu, Ala, Val, Gly, or Ile
  SITE (153)..(153): Xaa at position 153 is Ile, Ala, Val, Leu, or Gly
  SITE (154)..(154): Xaa at position 154 is Val, Ala, Gly, Leu, or Ile
  SITE (155)..(155): Xaa at position 155 is Leu, Ala, Val, Gly, or Ile
  SITE (161)..(161): Xaa at position 161 is Val, Ala, Gly, Leu, or Ile
  SITE (163)..(163): Xaa at position 163 is His, Phe, Tyr, Lys, Arg, Gly, Ser Thr, Ala, Val, Leu, Ile, Asn, Met, or Gln
  SITE (165)..(165): Xaa at position 165 is Val, Ala, Gly, Leu, or Ile
  SITE (167)..(167): Xaa at position 167 is Ile, Ala, Val, Leu, or Gly
  SITE (173)..(173): Xaa at position 173 is Leu, Ala, Val, Gly, or Ile
  SITE (176)..(176): Xaa at position 176 is Ala, Gly, or Pro
  SITE (178)..(178): Xaa at position 178 is Met, Ile, Leu, Val, Ala, or Gly
  SITE (180)..(180): Xaa at position 180 is Leu, Ala, Val, Gly, or Ile
  SITE (182)..(182): Xaa at position 182 is Leu, Ala, Val, Gly, or Ile
  SITE (183)..(183): Xaa at position 183 is Ala, Gly, or Pro
  SITE (187)..(187): Xaa at position 187 is Leu, Ala, Val, Gly, or Ile
  SITE (191)..(191): Xaa at position 191 is Leu, Ala, Val, Gly, or Ile
  SITE (194)..(194): Xaa at position 194 is Ile, Ala, Val, Leu, or Gly
  SITE (195)..(195): Xaa at position 195 is Leu, Ala, Val, Gly, or Ile
  SITE (206)..(206): Xaa at position 206 is Ala, Gly, or Pro
  SITE (210)..(210): Xaa at position 210 is Ile, Ala, Val, Leu, or Gly
  SITE (211)..(211): Xaa at position 211 is Val, Ala, Gly, Leu, or Ile
  SITE (214)..(214): Xaa at position 214 is Ile, Ala, Val, Leu, or Gly
  SITE (219)..(219): Xaa at position 219 is Cys, Ala, Val, Gly, Ser, or Thr
  SITE (221)..(221): Xaa at position 221 is Val, Ala, Gly, Leu, or Ile
  SITE (222)..(222): Xaa at position 222 is Ala, Gly, or Pro
  SITE (250)..(250): Xaa at position 250 is Ile, Ala, Val, Leu, or Gly
  SITE (252)..(252): Xaa at position 252 is Ile, Ala, Val, Leu, or Gly
  SITE (257)..(257): Xaa at position 257 is Phe, Tyr, Met, His, Ile, Leu, Val Ala, or Gly
  SITE (259)..(259): Xaa at position 259 is Cys, Ala, Val, Gly, Ser, or Thr
  SITE (263)..(263): Xaa at position 263 is Leu, Ala, Val, Gly, or Ile
  SITE (264)..(264): Xaa at position 264 is Phe, Tyr, Met, His, Ile, Leu, Val Ala, or Gly
  SITE (276)..(276): Xaa at position 276 is Ile, Ala, Val, Leu, or Gly
  SITE (284)..(284): Xaa at position 284 is Ile, Ala, Val, Leu, or Gly
  SITE (287)..(287): Xaa at position 287 is Cys, Ala, Val, Gly, Ser, or Thr
  SITE (289)..(289): Xaa at position 289 is Ile, Ala, Val, Leu, or Gly
  SITE (291)..(291): Xaa at position 291 is Ile, Ala, Val, Leu, or Gly
  SITE (295)..(295): Xaa at position 295 is Leu, Ala, Val, Gly, or Ile
  SITE (296)..(296): Xaa at position 296 is Tyr, Phe, Met, His, Ile, Leu, Val Ala, or Gly
  SITE (297)..(297): Xaa at position 297 is Ala, Gly, or Pro
  SITE (300)..(300): Xaa at position 300 is Val, Ala, Gly, Leu, or Ile
  SITE (301)..(301): Xaa at position 301 is Leu, Ala, Val, Gly, or Ile
  SITE (308)..(308): Xaa at position 308 is Tyr, Phe, Met, His, Ile, Leu, Val Ala, or Gly
  SITE (311)..(311): Xaa at position 311 is Ile, Ala, Val, Leu, or Gly
  SITE (315)..(315): Xaa at position 315 is Met, Ile, Leu, Val, Ala, or Gly
  SITE (319)..(319): Xaa at position 319 is Ile, Ala, Val, Leu, or Gly
  SITE (342)..(342): Xaa at position 342 is Trp, Tyr, Phe, Met, His, Ile, Leu Val, Ala, or Gly
  SITE (347)..(347): Xaa at position 347 is Ile, Ala, Val, Leu, or Gly
  SITE (354)..(354): Xaa at position 354 is Phe, Tyr, Met, His, Ile, Leu, Val Ala, or Gly
  SITE (358)..(358): Xaa at position 358 is Trp, Tyr, Phe, Met, His, Ile, Leu Val, Ala, or Gly
  SITE (359)..(359): Xaa at position 359 is Ile, Ala, Val, Leu, or Gly
  SITE (371)..(371): Xaa at position 371 is Ile, Ala, Val, Leu, or Gly
  SITE (372)..(372): Xaa at position 372 is Val, Ala, Gly, Leu, or Ile
  SITE (376)..(376): Xaa at position 376 is Cys, Ala, Val, Gly, Ser, or Thr
MCEEEDSTXXXXDNGSGLXKXGFAGDDAPRXXXPSXXGRPRHQGVMVGMGQKDSXVGDEXQSKRGIXTLKYPXEHGIITNWDDXEKXXHHSXYNELRVAPEEHPTXXTEXPXNPKANREKXTQXXXETXNXPXXYXAIQXXXSXYASGRTTGXXXDSGDGXTXNXPXYEGYAXPHXIXRXDXXGRDXTDYXMKXXTERGYSFVTTXEREXXRDXKEKLXYXXLDFENEMATAASSSSLEKSYELPDGQVXTXGNERXRXPETXXQPSFIGMESAGXHETTYNSXMKXDXDXRKDXXXNNXXSGGTTMXPGXADRXQKEXTALAPSTMKIKIIAPPERKYSVXIGGSXLASLSTXQQMXXSKQEYDEAGPSXXHRKXF

SEQ ID NO: 598 - protein, 115 aa, Homo sapiens
  SITE (78)..(78): Xaa at position 78 is Ala, Gly, or Pro
MTKKRRNNGRAKKGRGHVQPIRCTNCARCVPKDKAIKKFVIRNIVEAAAVRDISEASVFDAYVLPKLYVKLHYCVSCXIHSKVVRNRSREARKDRTPPPRFRPAGAAPRPPPKPM

SEQ ID NO: 599 - protein, 178 aa, Homo sapiens
  SITE (22)..(22): Xaa at position 22 is Leu, Ala, Val, Gly, or Ile
  SITE (36)..(36): Xaa at position 36 is Ala, Gly, or Pro
  SITE (40)..(40): Xaa at position 40 is Leu, Ala, Val, Gly, or Ile
  SITE (70)..(70): Xaa at position 70 is Val, Ala, Gly, Leu, or Ile
  SITE (74)..(74): Xaa at position 74 is Val, Ala, Gly, Leu, or Ile
  SITE (82)..(82): Xaa at position 82 is Ile, Ala, Val, Leu, or Gly
  SITE (87)..(87): Xaa at position 87 is Leu, Ala, Val, Gly, or Ile
  SITE (105)..(105): Xaa at position 105 is Phe, Tyr, Met, His, Ile, Leu, Val Ala, or Gly
MAQDQGEKENPMRELRIRKLCXNICVGESGDRLTRXAKVXEQLTGQTPVFSKARYTVRSFGIRRNEKIAXHCTXRGAKAEEXLEKGXKVREYELRKNNFSDTGNXGFGIQEHIDLGIKYDPSIGIYGLDFYVVLGRPGFSIADKKRRTGCIGAKHRISKEEAMRWFQQKYDGIILPGK

SEQ ID NO: 600 - protein, 394 aa, Homo sapiens
  SITE (43)..(43): Xaa at position 43 is Leu, Ala, Val, Gly, or Ile
  SITE (44)..(44): Xaa at position 44 is Leu, Ala, Val, Gly, or Ile
  SITE (45)..(45): Xaa at position 45 is Leu, Ala, Val, Gly, or Ile
  SITE (46)..(46): Xaa at position 46 is Leu, Ala, Val, Gly, or Ile
  SITE (56)..(56): Xaa at position 56 is Ile, Ala, Val, Leu, or Gly
  SITE (60)..(60): Xaa at position 60 is Met, Ile, Leu, Val, Ala, or Gly
  SITE (95)..(95): Xaa at position 95 is Ile, Ala, Val, Leu, or Gly
  SITE (99)..(99): Xaa at position 99 is Leu, Ala, Val, Gly, or Ile
  SITE (102)..(102): Xaa at position 102 is Ala, Gly, or Pro
  SITE (103)..(103): Xaa at position 103 is Ile, Ala, Val, Leu, or Gly
  SITE (106)..(106): Xaa at position 106 is Ile, Ala, Val, Leu, or Gly
  SITE (113)..(113): Xaa at position 113 is Leu, Ala, Val, Gly, or Ile
  SITE (131)..(131): Xaa at position 131 is Ile, Ala, Val, Leu, or Gly
  SITE (146)..(146): Xaa at position 146 is Phe, Tyr, Met, His, Ile, Leu, Val Ala, or Gly
  SITE (150)..(150): Xaa at position 150 is Ala, Gly, or Pro
  SITE (153)..(153): Xaa at position 153 is Leu, Ala, Val, Gly, or Ile
  SITE (159)..(159): Xaa at position 159 is Val, Ala, Gly, Leu, or Ile
  SITE (162)..(162): Xaa at position 162 is Cys, Ala, Val, Gly, Ser, or Thr
  SITE (174)..(174): Xaa at position 174 is Cys, Ala, Val, Gly, Ser, or Thr
  SITE (175)..(175): Xaa at position 175 is Ala, Gly, or Pro
  SITE (178)..(178): Xaa at position 178 is Phe, Tyr, Met, His, Ile, Leu, Val Ala, or Gly
  SITE (182)..(182): Xaa at position 182 is Ile, Ala, Val, Leu, or Gly
  SITE (185)..(185): Xaa at position 185 is Ile, Ala, Val, Leu, or Gly
  SITE (219)..(219): Xaa at position 219 is Phe, Tyr, Met, His, Ile, Leu, Val Ala, or Gly
  SITE (221)..(221): Xaa at position 221 is Met, Ile, Leu, Val, Ala, or Gly
  SITE (224)..(224): Xaa at position 224 is Val, Ala, Gly, Leu, or Ile
  SITE (243)..(243): Xaa at position 243 is Ala, Gly, or Pro
  SITE (244)..(244): Xaa at position 244 is Ile, Ala, Val, Leu, or Gly
  SITE (246)..(246): Xaa at position 246 is Phe, Tyr, Met, His, Ile, Leu, Val Ala, or Gly
  SITE (247)..(247): Xaa at position 247 is Val, Ala, Gly, Leu, or Ile
  SITE (248)..(248): Xaa at position 248 is Val, Ala, Gly, Leu, or Ile
  SITE (253)..(253): Xaa at position 253 is Tyr, Phe, Met, His, Ile, Leu, Val Ala, or Gly
  SITE (273)..(273): Xaa at position 273 is Phe, Tyr, Met, His, Ile, Leu, Val Ala, or Gly
  SITE (282)..(282): Xaa at position 282 is Leu, Ala, Val, Gly, or Ile
  SITE (287)..(287): Xaa at position 287 is Val, Ala, Gly, Leu, or Ile
  SITE (288)..(288): Xaa at position 288 is Ile, Ala, Val, Leu, or Gly
  SITE (289)..(289): Xaa at position 289 is Leu, Ala, Val, Gly, or Ile
  SITE (291)..(291): Xaa at position 291 is Leu, Ala, Val, Gly, or Ile
  SITE (296)..(296): Xaa at position 296 is Leu, Ala, Val, Gly, or Ile
  SITE (297)..(297): Xaa at position 297 is Leu, Ala, Val, Gly, or Ile
  SITE (301)..(301): Xaa at position 301 is Val, Ala, Gly, Leu, or Ile
  SITE (337)..(337): Xaa at position 337 is Ala, Gly, or Pro
  SITE (341)..(341): Xaa at position 341 is Ile, Ala, Val, Leu, or Gly
  SITE (345)..(345): Xaa at position 345 is Phe, Tyr, Met, His, Ile, Leu, Val Ala, or Gly
  SITE (351)..(351): Xaa at position 351 is Ala, Gly, or Pro
  SITE (372)..(372): Xaa at position 372 is Ile, Ala, Val, Leu, or Gly
  SITE (379)..(379): Xaa at position 379 is Cys, Ala, Val, Gly, Ser, or Thr
  SITE (383)..(383): Xaa at position 383 is Ile, Ala, Val, Leu, or Gly
  SITE (387)..(387): Xaa at position 387 is His, Phe, Tyr, Lys, Arg, Gly, Ser Thr, Ala, Val, Leu, Ile, Asn, Met, or Gln
MGCLGNSKTEDQRNEEKAQREANKKIEKQLQKDKQVYRATHRXXXXGAGESGKSTXVKQXRILHVNGFNGEGGEEDPQAARSNSDGEKATKVQDXKNNXKEXXETXVAAMSNXVPPVELANPENQFRVDYXLSVMNVPDFDFPPEXYEHXKAXWEDEGXRAXYERSNEYQLIDXXQYXLDKXDVXKQADYVPSDQDLLRCRVLTSGIFETKFQVDKVNXHXFDXGGQRDERRKWIQCFNDVTXXIXXXASSSXNMVIREDNQTNRLQEALNLXKSIWNNRWXRTISXXXFXNKQDXXAEKXLAGKSKIEDYFPEFARYTTPEDATPEPGEDPRVTRXKYFXRDEXLRISTXSGDGRHYCYPHFTCAVDTENXRRVFNDXRDIXQRMXLRQYELL

SEQ ID NO: 601 - protein, 427 aa, Homo sapiens
  SITE (161)..(161): Xaa at position 161 is Val, Ala, Gly, Leu, or Ile
  SITE (245)..(245): Xaa at position 245 is Leu, Ala, Val, Gly, or Ile
  SITE (250)..(250): Xaa at position 250 is Ile, Ala, Val, Leu, or Gly
  SITE (267)..(267): Xaa at position 267 is Ile, Ala, Val, Leu, or Gly
  SITE (298)..(298): Xaa at position 298 is Leu, Ala, Val, Gly, or Ile
  SITE (362)..(362): Xaa at position 362 is Ala, Gly, or Pro
  SITE (374)..(374): Xaa at position 374 is Phe, Tyr, Met, His, Ile, Leu, Val Ala, or Gly
MGSVRTNRYSIVSSEEDGMKLATMAVANGFGNGKSKVHTRQQCRSRFVKKDGHCNVQFINVGEKGQRYLADIFTTCVDIRWRWMLVIFCLAFVLSWLFFGCVFWLIALLHGDLDASKEGKACVSEVNSFTAAFLFSIETQTTIGYGFRCVTDECPIAVFMXVFQSIVGCIIDAFIIGAVMAKMAKPKKRNETLVFSHNAVIAMRDGKLCLMWRVGNLRKSHLVEAHVRAQLLKSRITSEGEYIPXDQIDXNVGFDSGIDRIFLVSPXTIVHEIDEDSPLYDLSKQDIDNADFEIVVIXEGMVEATAMTTQCRSSYLANEILWGHRYEPVLFEEKHYYKVDYSRFHKTYEVPNTPLCSARDLXEKKYILSNANSXCYENEVALTSKEEDDSENGVPESTSTDTPPDIDLHNQASVPLEPRPLRRESEI

SEQ ID NO: 602 - protein, 215 aa, Homo sapiens
  SITE (21)..(21): Xaa at position 21 is Phe, Tyr, Met, His, Ile, Leu, Val Ala, or Gly
  SITE (23)..(23): Xaa at position 23 is Cys, Ala, Val, Gly, Ser, or Thr
  SITE (25)..(25): Xaa at position 25 is Val, Ala, Gly, Leu, or Ile
  SITE (30)..(30): Xaa at position 30 is Ile, Ala, Val, Leu, or Gly
  SITE (36)..(36): Xaa at position 36 is Leu, Ala, Val, Gly, or Ile
  SITE (39)..(39): Xaa at position 39 is Leu, Ala, Val, Gly, or Ile
  SITE (49)..(49): Xaa at position 49 is Ala, Gly, or Pro
  SITE (53)..(53): Xaa at position 53 is Ile, Ala, Val, Leu, or Gly
  SITE (75)..(75): Xaa at position 75 is Ala, Gly, or Pro
  SITE (76)..(76): Xaa at position 76 is Ala, Gly, or Pro
  SITE (79)..(79): Xaa at position 79 is Leu, Ala, Val, Gly, or Ile
  SITE (80)..(80): Xaa at position 80 is Tyr, Phe, Met, His, Ile, Leu, Val Ala, or Gly
  SITE (83)..(83): Xaa at position 83 is Ile, Ala, Val, Leu, or Gly
  SITE (84)..(84): Xaa at position 84 is His, Phe, Tyr, Lys, Arg, Gly, Ser Thr, Ala, Val, Leu, Ile, Asn, Met, or Gln
  SITE (87)..(87): Xaa at position 87 is Tyr, Phe, Met, His, Ile, Leu, Val Ala, or Gly
  SITE (88)..(88): Xaa at position 88 is Ile, Ala, Val, Leu, or Gly
  SITE (94)..(94): Xaa at position 94 is Ile, Ala, Val, Leu, or Gly
  SITE (97)..(97): Xaa at position 97 is Met, Ile, Leu, Val, Ala, or Gly
  SITE (106)..(106): Xaa at position 106 is Phe, Tyr, Met, His, Ile, Leu, Val Ala, or Gly
  SITE (114)..(114): Xaa at position 114 is Cys, Ala, Val, Gly, Ser, or Thr
  SITE (119)..(119): Xaa at position 119 is Met, Ile, Leu, Val, Ala, or Gly
  SITE (120)..(120): Xaa at position 120 is Leu, Ala, Val, Gly, or Ile
  SITE (133)..(133): Xaa at position 133 is Val, Ala, Gly, Leu, or Ile
  SITE (137)..(137): Xaa at position 137 is Cys, Ala, Val, Gly, Ser, or Thr
  SITE (159)..(159): Xaa at position 159 is Phe, Tyr, Met, His, Ile, Leu, Val Ala, or Gly
  SITE (163)..(163): Xaa at position 163 is Phe, Tyr, Met, His, Ile, Leu, Val Ala, or Gly
  SITE (167)..(167): Xaa at position 167 is Leu, Ala, Val, Gly, or Ile
MSSSEEVSWISWFCGLRGNEXFXEXDEDYXQDKFNXTGXNEQVPHYRQXLDMXLDLEPDEELEDNPNQSDLIEQXXEMXXGLXXARXXLTNRGXAQXLEKYQQGDXGYCPRVYXENQPXXPIGLSDIPGEAMXKLYXPKCMDVYTPKSSRHHHTDGAYXGTGXPHMXFMVHPEYRPKRPANQFVPRLYGFKIHPMAYQLQLQAASNFKSPVKTIR

SEQ ID NO: 603 - protein, 377 aa, Homo sapiens
  SITE (9)..(9): Xaa at position 9 is Ala, Gly, or Pro
  SITE (10)..(10): Xaa at position 10 is Leu, Ala, Val, Gly, or Ile
  SITE (11)..(11): Xaa at position 11 is Val, Ala, Gly, Leu, or Ile
  SITE (12)..(12): Xaa at position 12 is Cys, Ala, Val, Gly, Ser, or Thr
  SITE (19)..(19): Xaa at position 19 is Val, Ala, Gly, Leu, or Ile
  SITE (21)..(21): Xaa at position 21 is Ala, Gly, or Pro
  SITE (31)..(31): Xaa at position 31 is Ala, Gly, or Pro
  SITE (32)..(32): Xaa at position 32 is Val, Ala, Gly, Leu, or Ile
  SITE (33)..(33): Xaa at position 33 is Phe, Tyr, Met, His, Ile, Leu, Val Ala, or Gly
  SITE (36)..(36): Xaa at position 36 is Ile, Ala, Val, Leu, or Gly
  SITE (37)..(37): Xaa at position 37 is Val, Ala, Gly, Leu, or Ile
  SITE (55)..(55): Xaa at position 55 is Tyr, Phe, Met, His, Ile, Leu, Val Ala, or Gly
  SITE (60)..(60): Xaa at position 60 is Ala, Gly, or Pro
  SITE (67)..(67): Xaa at position 67 is Leu, Ala, Val, Gly, or Ile
  SITE (73)..(73): Xaa at position 73 is Ile, Ala, Val, Leu, or Gly
  SITE (84)..(84): Xaa at position 84 is Met, Ile, Leu, Val, Ala, or Gly
  SITE (87)..(87): Xaa at position 87 is Ile, Ala, Val, Leu, or Gly
  SITE (88)..(88): Xaa at position 88 is Trp, Tyr, Phe, Met, His, Ile, Leu Val, Ala, or Gly
  SITE (92)..(92): Xaa at position 92 is Phe, Tyr, Met, His, Ile, Leu, Val Ala, or Gly
  SITE (106)..(106): Xaa at position 106 is Leu, Ala, Val, Gly, or Ile
  SITE (107)..(107): Xaa at position 107 is Leu, Ala, Val, Gly, or Ile
  SITE (110)..(110): Xaa at position 110 is Ala, Gly, or Pro
  SITE (112)..(112): Xaa at position 112 is Leu, Ala, Val, Gly, or Ile
  SITE (121)..(121): Xaa at position 121 is Met, Ile, Leu, Val, Ala, or Gly
  SITE (124)..(124): Xaa at position 124 is Ile, Ala, Val, Leu, or Gly
  SITE (125)..(125): Xaa at position 125 is Met, Ile, Leu, Val, Ala, or Gly
  SITE (126)..(126): Xaa at position 126 is Phe, Tyr, Met, His, Ile, Leu, Val Ala, or Gly
  SITE (129)..(129): Xaa at position 129 is Phe, Tyr, Met, His, Ile, Leu, Val Ala, or Gly
  SITE (131)..(131): Xaa at position 131 is Val, Ala, Gly, Leu, or Ile
  SITE (133)..(133): Xaa at position 133 is Ala, Gly, or Pro
  SITE (134)..(134): Xaa at position 134 is Met, Ile, Leu, Val, Ala, or Gly
  SITE (136)..(136): Xaa at position 136 is Val, Ala, Gly, Leu, or Ile
  SITE (140)..(140): Xaa at position 140 is Ala, Gly, or Pro
  SITE (141)..(141): Xaa at position 141 is Val, Ala, Gly, Leu, or Ile
  SITE (142)..(142): Xaa at position 142 is Leu, Ala, Val, Gly, or Ile
  SITE (144)..(144): Xaa at position 144 is Leu, Ala, Val, Gly, or Ile
  SITE (153)..(153): Xaa at position 153 is Ile, Ala, Val, Leu, or Gly
  SITE (154)..(154): Xaa at position 154 is Val, Ala, Gly, Leu, or Ile
  SITE (155)..(155): Xaa at position 155 is Leu, Ala, Val, Gly, or Ile
  SITE (161)..(161): Xaa at position 161 is Val, Ala, Gly, Leu, or Ile
  SITE (163)..(163): Xaa at position 163 is His, Phe, Tyr, Lys, Arg, Gly, Ser Thr, Ala, Val, Leu, Ile, Asn, Met, or Gln
  SITE (165)..(165): Xaa at position 165 is Val, Ala, Gly, Leu, or Ile
  SITE (167)..(167): Xaa at position 167 is Ile, Ala, Val, Leu, or Gly
  SITE (173)..(173): Xaa at position 173 is Leu, Ala, Val, Gly, or Ile
  SITE (176)..(176): Xaa at position 176 is Ala, Gly, or Pro
  SITE (178)..(178): Xaa at position 178 is Met, Ile, Leu, Val, Ala, or Gly
  SITE (180)..(180): Xaa at position 180 is Leu, Ala, Val, Gly, or Ile
  SITE (182)..(182): Xaa at position 182 is Leu, Ala, Val, Gly, or Ile
  SITE (183)..(183): Xaa at position 183 is Ala, Gly, or Pro
  SITE (187)..(187): Xaa at position 187 is Leu, Ala, Val, Gly, or Ile
  SITE (191)..(191): Xaa at position 191 is Leu, Ala, Val, Gly, or Ile
  SITE (194)..(194): Xaa at position 194 is Ile, Ala, Val, Leu, or Gly
  SITE (195)..(195): Xaa at position 195 is Leu, Ala, Val, Gly, or Ile
  SITE (206)..(206): Xaa at position 206 is Ala, Gly, or Pro
  SITE (210)..(210): Xaa at position 210 is Ile, Ala, Val, Leu, or Gly
  SITE (211)..(211): Xaa at position 211 is Val, Ala, Gly, Leu, or Ile
  SITE (214)..(214): Xaa at position 214 is Ile, Ala, Val, Leu, or Gly
  SITE (219)..(219): Xaa at position 219 is Cys, Ala, Val, Gly, Ser, or Thr
  SITE (221)..(221): Xaa at position 221 is Val, Ala, Gly, Leu, or Ile
  SITE (222)..(222): Xaa at position 222 is Ala, Gly, or Pro
  SITE (250)..(250): Xaa at position 250 is Ile, Ala, Val, Leu, or Gly
  SITE (252)..(252): Xaa at position 252 is Ile, Ala, Val, Leu, or Gly
  SITE (257)..(257): Xaa at position 257 is Phe, Tyr, Met, His, Ile, Leu, Val Ala, or Gly
  SITE (259)..(259): Xaa at position 259 is Cys, Ala, Val, Gly, Ser, or Thr
  SITE (263)..(263): Xaa at position 263 is Leu, Ala, Val, Gly, or Ile
  SITE (264)..(264): Xaa at position 264 is Phe, Tyr, Met, His, Ile, Leu, Val Ala, or Gly
  SITE (276)..(276): Xaa at position 276 is Ile, Ala, Val, Leu, or Gly
  SITE (284)..(284): Xaa at position 284 is Ile, Ala, Val, Leu, or Gly
  SITE (287)..(287): Xaa at position 287 is Cys, Ala, Val, Gly, Ser, or Thr
  SITE (289)..(289): Xaa at position 289 is Ile, Ala, Val, Leu, or Gly
  SITE (291)..(291): Xaa at position 291 is Ile, Ala, Val, Leu, or Gly
  SITE (295)..(295): Xaa at position 295 is Leu, Ala, Val, Gly, or Ile
  SITE (296)..(296): Xaa at position 296 is Tyr, Phe, Met, His, Ile, Leu, Val Ala, or Gly
  SITE (297)..(297): Xaa at position 297 is Ala, Gly, or Pro
  SITE (300)..(300): Xaa at position 300 is Val, Ala, Gly, Leu, or Ile
  SITE (301)..(301): Xaa at position 301 is Leu, Ala, Val, Gly, or Ile
  SITE (308)..(308): Xaa at position 308 is Tyr, Phe, Met, His, Ile, Leu, Val Ala, or Gly
  SITE (311)..(311): Xaa at position 311 is Ile, Ala, Val, Leu, or Gly
  SITE (315)..(315): Xaa at position 315 is Met, Ile, Leu, Val, Ala, or Gly
  SITE (319)..(319): Xaa at position 319 is Ile, Ala, Val, Leu, or Gly
  SITE (342)..(342): Xaa at position 342 is Trp, Tyr, Phe, Met, His, Ile, Leu Val, Ala, or Gly
  SITE (347)..(347): Xaa at position 347 is Ile, Ala, Val, Leu, or Gly
  SITE (354)..(354): Xaa at position 354 is Phe, Tyr, Met, His, Ile, Leu, Val Ala, or Gly
  SITE (358)..(358): Xaa at position 358 is Trp, Tyr, Phe, Met, His, Ile, Leu Val, Ala, or Gly
  SITE (359)..(359): Xaa at position 359 is Ile, Ala, Val, Leu, or Gly
  SITE (371)..(371): Xaa at position 371 is Ile, Ala, Val, Leu, or Gly
  SITE (372)..(372): Xaa at position 372 is Val, Ala, Gly, Leu, or Ile
  SITE (376)..(376): Xaa at position 376 is Cys, Ala, Val, Gly, Ser, or Thr
MCDDEETTXXXXDNGSGLXKXGFAGDDAPRXXXPSXXGRPRHQGVMVGMGQKDSXVGDEXQSKRGIXTLKYPXEHGIITNWDDXEKXXHHTXYNELRVAPEEHPTXXTEXPXNPKANREKXTQXXXETXNXPXXYXAIQXXXSXYASGRTTGXXXDSGDGXTXNXPXYEGYAXPHXIXRXDXXGRDXTDYXMKXXTERGYSFVTTXEREXXRDXKEKLXYXXLDFENEMATAASSSSLEKSYELPDGQVXTXGNERXRXPETXXQPSFIGMESAGXHETTYNSXMKXDXDXRKDXXXNNXXSGGTTMXPGXADRXQKEXTALAPSTMKIKIIAPPERKYSVXIGGSXLASLSTXQQMXXSKQEYDEAGPSXXHRKXF

SEQ ID NO: 604 - protein, 154 aa, Homo sapiens
  SITE (3)..(3): Xaa at position 3 is Ala, Gly, or Pro
  SITE (7)..(7): Xaa at position 7 is Leu, Ala, Val, Gly, or Ile
  SITE (14)..(14): Xaa at position 14 is Ile, Ala, Val, Leu, or Gly
  SITE (22)..(22): Xaa at position 22 is Phe, Tyr, Met, His, Ile, Leu, Val Ala, or Gly
  SITE (35)..(35): Xaa at position 35 is Trp, Tyr, Phe, Met, His, Ile, Leu Val, Ala, or Gly
  SITE (39)..(39): Xaa at position 39 is Ile, Ala, Val, Leu, or Gly
  SITE (46)..(46): Xaa at position 46 is Tyr, Phe, Met, His, Ile, Leu, Val Ala, or Gly
  SITE (50)..(50): Xaa at position 50 is Ala, Gly, or Pro
  SITE (51)..(51): Xaa at position 51 is Phe, Tyr, Met, His, Ile, Leu, Val Ala, or Gly
  SITE (53)..(53): Xaa at position 53 is Ile, Ala, Val, Leu, or Gly
  SITE (55)..(55): Xaa at position 55 is Ile, Ala, Val, Leu, or Gly
  SITE (70)..(70): Xaa at position 70 is Phe, Tyr, Met, His, Ile, Leu, Val Ala, or Gly
  SITE (76)..(76): Xaa at position 76 is His, Phe, Tyr, Lys, Arg, Gly, Ser Thr, Ala, Val, Leu, Ile, Asn, Met, or Gln
  SITE (79)..(79): Xaa at position 79 is Ile, Ala, Val, Leu, or Gly
  SITE (104)..(104): Xaa at position 104 is Val, Ala, Gly, Leu, or Ile
  SITE (105)..(105): Xaa at position 105 is Ile, Ala, Val, Leu, or Gly
  SITE (108)..(108): Xaa at position 108 is Leu, Ala, Val, Gly, or Ile
  SITE (111)..(111): Xaa at position 111 is Leu, Ala, Val, Gly, or Ile
  SITE (112)..(112): Xaa at position 112 is Val, Ala, Gly, Leu, or Ile
  SITE (125)..(125): Xaa at position 125 is Leu, Ala, Val, Gly, or Ile
  SITE (136)..(136): Xaa at position 136 is Phe, Tyr, Met, His, Ile, Leu, Val Ala, or Gly
  SITE (140)..(140): Xaa at position 140 is Ala, Gly, or Pro
MAXSRRXMKELEEXRKCGMKNXRNIQVDEANLLTXQGLXVPDNPPXDKGXXRXEXNFPAEYPFKPPKITXKTKIYXPNXDEKGQVCLPVISAENWKPATKTDQXXQSXIAXXNDPQPEHPLRADXAEEYSKDRKKXCKNXEEFTKKYGEKRPVD

SEQ ID NO: 605 - protein, 377 aa, Homo sapiens
  SITE (9)..(9): Xaa at position 9 is Ala, Gly, or Pro
  SITE (10)..(10): Xaa at position 10 is Leu, Ala, Val, Gly, or Ile
  SITE (11)..(11): Xaa at position 11 is Val, Ala, Gly, Leu, or Ile
  SITE (12)..(12): Xaa at position 12 is Cys, Ala, Val, Gly, Ser, or Thr
  SITE (19)..(19): Xaa at position 19 is Val, Ala, Gly, Leu, or Ile
  SITE (21)..(21): Xaa at position 21 is Ala, Gly, or Pro
  SITE (31)..(31): Xaa at position 31 is Ala, Gly, or Pro
  SITE (32)..(32): Xaa at position 32 is Val, Ala, Gly, Leu, or Ile
  SITE (33)..(33): Xaa at position 33 is Phe, Tyr, Met, His, Ile, Leu, Val Ala, or Gly
  SITE (36)..(36): Xaa at position 36 is Ile, Ala, Val, Leu, or Gly
  SITE (37)..(37): Xaa at position 37 is Val, Ala, Gly, Leu, or Ile
  SITE (55)..(55): Xaa at position 55 is Tyr, Phe, Met, His, Ile, Leu, Val Ala, or Gly
  SITE (60)..(60): Xaa at position 60 is Ala, Gly, or Pro
  SITE (67)..(67): Xaa at position 67 is Leu, Ala, Val, Gly, or Ile
  SITE (73)..(73): Xaa at position 73 is Ile, Ala, Val, Leu, or Gly
  SITE (84)..(84): Xaa at position 84 is Met, Ile, Leu, Val, Ala, or Gly
  SITE (87)..(87): Xaa at position 87 is Ile, Ala, Val, Leu, or Gly
  SITE (88)..(88): Xaa at position 88 is Trp, Tyr, Phe, Met, His, Ile, Leu Val, Ala, or Gly
  SITE (92)..(92): Xaa at position 92 is Phe, Tyr, Met, His, Ile, Leu, Val Ala, or Gly
  SITE (106)..(106): Xaa at position 106 is Leu, Ala, Val, Gly, or Ile
  SITE (107)..(107): Xaa at position 107 is Leu, Ala, Val, Gly, or Ile
  SITE (110)..(110): Xaa at position 110 is Ala, Gly, or Pro
  SITE (112)..(112): Xaa at position 112 is Leu, Ala, Val, Gly, or Ile
  SITE (121)..(121): Xaa at position 121 is Met, Ile, Leu, Val, Ala, or Gly
  SITE (124)..(124): Xaa at position 124 is Ile, Ala, Val, Leu, or Gly
  SITE (125)..(125): Xaa at position 125 is Met, Ile, Leu, Val, Ala, or Gly
  SITE (126)..(126): Xaa at position 126 is Phe, Tyr, Met, His, Ile, Leu, Val Ala, or Gly
  SITE (129)..(129): Xaa at position 129 is Phe, Tyr, Met, His, Ile, Leu, Val Ala, or Gly
  SITE (131)..(131): Xaa at position 131 is Val, Ala, Gly, Leu, or Ile
  SITE (133)..(133): Xaa at position 133 is Ala, Gly, or Pro
  SITE (134)..(134): Xaa at position 134 is Met, Ile, Leu, Val, Ala, or Gly
  SITE (136)..(136): Xaa at position 136 is Val, Ala, Gly, Leu, or Ile
  SITE (140)..(140): Xaa at position 140 is Ala, Gly, or Pro
  SITE (141)..(141): Xaa at position 141 is Val, Ala, Gly, Leu, or Ile
  SITE (142)..(142): Xaa at position 142 is Leu, Ala, Val, Gly, or Ile
  SITE (144)..(144): Xaa at position 144 is Leu, Ala, Val, Gly, or Ile
  SITE (153)..(153): Xaa at position 153 is Ile, Ala, Val, Leu, or Gly
  SITE (154)..(154): Xaa at position 154 is Val, Ala, Gly, Leu, or Ile
  SITE (155)..(155): Xaa at position 155 is Leu, Ala, Val, Gly, or Ile
  SITE (161)..(161): Xaa at position 161 is Val, Ala, Gly, Leu, or Ile
  SITE (163)..(163): Xaa at position 163 is His, Phe, Tyr, Lys, Arg, Gly, Ser Thr, Ala, Val, Leu, Ile, Asn, Met, or Gln
  SITE (165)..(165): Xaa at position 165 is Val, Ala, Gly, Leu, or Ile
  SITE (167)..(167): Xaa at position 167 is Ile, Ala, Val, Leu, or Gly
  SITE (173)..(173): Xaa at position 173 is Leu, Ala, Val, Gly, or Ile
  SITE (176)..(176): Xaa at position 176 is Ala, Gly, or Pro
  SITE (178)..(178): Xaa at position 178 is Met, Ile, Leu, Val, Ala, or Gly
  SITE (180)..(180): Xaa at position 180 is Leu, Ala, Val, Gly, or Ile
  SITE (182)..(182): Xaa at position 182 is Leu, Ala, Val, Gly, or Ile
  SITE (183)..(183): Xaa at position 183 is Ala, Gly, or Pro
  SITE (187)..(187): Xaa at position 187 is Leu, Ala, Val, Gly, or Ile
  SITE (191)..(191): Xaa at position 191 is Leu, Ala, Val, Gly, or Ile
  SITE (194)..(194): Xaa at position 194 is Ile, Ala, Val, Leu, or Gly
  SITE (195)..(195): Xaa at position 195 is Leu, Ala, Val, Gly, or Ile
  SITE (206)..(206): Xaa at position 206 is Ala, Gly, or Pro
  SITE (210)..(210): Xaa at position 210 is Ile, Ala, Val, Leu, or Gly
  SITE (211)..(211): Xaa at position 211 is Val, Ala, Gly, Leu, or Ile
  SITE (214)..(214): Xaa at position 214 is Ile, Ala, Val, Leu, or Gly
  SITE (219)..(219): Xaa at position 219 is Cys, Ala, Val, Gly, Ser, or Thr
  SITE (221)..(221): Xaa at position 221 is Val, Ala, Gly, Leu, or Ile
  SITE (222)..(222): Xaa at position 222 is Ala, Gly, or Pro
  SITE (250)..(250): Xaa at position 250 is Ile, Ala, Val, Leu, or Gly
  SITE (252)..(252): Xaa at position 252 is Ile, Ala, Val, Leu, or Gly
  SITE (257)..(257): Xaa at position 257 is Phe, Tyr, Met, His, Ile, Leu, Val Ala, or Gly
  SITE (259)..(259): Xaa at position 259 is Cys, Ala, Val, Gly, Ser, or Thr
  SITE (263)..(263): Xaa at position 263 is Leu, Ala, Val, Gly, or Ile
  SITE (264)..(264): Xaa at position 264 is Phe, Tyr, Met, His, Ile, Leu, Val Ala, or Gly
  SITE (276)..(276): Xaa at position 276 is Ile, Ala, Val, Leu, or Gly
  SITE (284)..(284): Xaa at position 284 is Ile, Ala, Val, Leu, or Gly
  SITE (287)..(287): Xaa at position 287 is Cys, Ala, Val, Gly, Ser, or Thr
  SITE (289)..(289): Xaa at position 289 is Ile, Ala, Val, Leu, or Gly
  SITE (291)..(291): Xaa at position 291 is Ile, Ala, Val, Leu, or Gly
  SITE (295)..(295): Xaa at position 295 is Leu, Ala, Val, Gly, or Ile
  SITE (296)..(296): Xaa at position 296 is Tyr, Phe, Met, His, Ile, Leu, Val Ala, or Gly
  SITE (297)..(297): Xaa at position 297 is Ala, Gly, or Pro
  SITE (300)..(300): Xaa at position 300 is Val, Ala, Gly, Leu, or Ile
  SITE (301)..(301): Xaa at position 301 is Met, Ile, Leu, Val, Ala, or Gly
  SITE (308)..(308): Xaa at position 308 is Tyr, Phe, Met, His, Ile, Leu, Val Ala, or Gly
  SITE (311)..(311): Xaa at position 311 is Ile, Ala, Val, Leu, or Gly
  SITE (315)..(315): Xaa at position 315 is Met, Ile, Leu, Val, Ala, or Gly
  SITE (319)..(319): Xaa at position 319 is Ile, Ala, Val, Leu, or Gly
  SITE (342)..(342): Xaa at position 342 is Trp, Tyr, Phe, Met, His, Ile, Leu Val, Ala, or Gly
  SITE (347)..(347): Xaa at position 347 is Ile, Ala, Val, Leu, or Gly
  SITE (354)..(354): Xaa at position 354 is Phe, Tyr, Met, His, Ile, Leu, Val Ala, or Gly
  SITE (358)..(358): Xaa at position 358 is Trp, Tyr, Phe, Met, His, Ile, Leu Val, Ala, or Gly
  SITE (359)..(359): Xaa at position 359 is Ile, Ala, Val, Leu, or Gly
  SITE (371)..(371): Xaa at position 371 is Ile, Ala, Val, Leu, or Gly
  SITE (372)..(372): Xaa at position 372 is Val, Ala, Gly, Leu, or Ile
  SITE (376)..(376): Xaa at position 376 is Cys, Ala, Val, Gly, Ser, or Thr
MCDEDETTXXXXDNGSGLXKXGFAGDDAPRXXXPSXXGRPRHQGVMVGMGQKDSXVGDEXQSKRGIXTLKYPXEHGIITNWDDXEKXXHHTXYNELRVAPEEHPTXXTEXPXNPKANREKXTQXXXETXNXPXXYXAIQXXXSXYASGRTTGXXXDSGDGXTXNXPXYEGYAXPHXIXRXDXXGRDXTDYXMKXXTERGYSFVTTXEREXXRDXKEKLXYXXLDFENEMATAASSSSLEKSYELPDGQVXTXGNERXRXPETXXQPSFIGMESAGXHETTYNSXMKXDXDXRKDXXXNNXXSGGTTMXPGXADRXQKEXTALAPSTMKIKIIAPPERKYSVXIGGSXLASLSTXQQMXXTKQEYDEAGPSXXHRKXF

SEQ ID NO: 606 - protein, 147 aa, Homo sapiens
  SITE (4)..(4): Xaa at position 4 is Leu, Ala, Val, Gly, or Ile
  SITE (12)..(12): Xaa at position 12 is Val, Ala, Gly, Leu, or Ile
  SITE (15)..(15): Xaa at position 15 is Leu, Ala, Val, Gly, or Ile
  SITE (24)..(24): Xaa at position 24 is Val, Ala, Gly, Leu, or Ile
  SITE (28)..(28): Xaa at position 28 is Ala, Gly, or Pro
  SITE (29)..(29): Xaa at position 29 is Leu, Ala, Val, Gly, or Ile
  SITE (32)..(32): Xaa at position 32 is Leu, Ala, Val, Gly, or Ile
  SITE (33)..(33): Xaa at position 33 is Leu, Ala, Val, Gly, or Ile
  SITE (49)..(49): Xaa at position 49 is Leu, Ala, Val, Gly, or Ile
  SITE (55)..(55): Xaa at position 55 is Val, Ala, Gly, Leu, or Ile
  SITE (61)..(61): Xaa at position 61 is Val, Ala, Gly, Leu, or Ile
  SITE (69)..(69): Xaa at position 69 is Leu, Ala, Val, Gly, or Ile
  SITE (72)..(72): Xaa at position 72 is Phe, Tyr, Met, His, Ile, Leu, Val Ala, or Gly
  SITE (79)..(79): Xaa at position 79 is Leu, Ala, Val, Gly, or Ile
  SITE (82)..(82): Xaa at position 82 is Leu, Ala, Val, Gly, or Ile
  SITE (86)..(86): Xaa at position 86 is Phe, Tyr, Met, His, Ile, Leu, Val Ala, or Gly
  SITE (94)..(94): Xaa at position 94 is Cys, Ala, Val, Gly, Ser, or Thr
  SITE (111)..(111): Xaa at position 111 is Leu, Ala, Val, Gly, or Ile
  SITE (114)..(114): Xaa at position 114 is Val, Ala, Gly, Leu, or Ile
  SITE (115)..(115): Xaa at position 115 is Leu, Ala, Val, Gly, or Ile
  SITE (119)..(119): Xaa at position 119 is Phe, Tyr, Met, His, Ile, Leu, Val Ala, or Gly
  SITE (127)..(127): Xaa at position 127 is Val, Ala, Gly, Leu, or Ile
  SITE (130)..(130): Xaa at position 130 is Ala, Gly, or Pro
  SITE (131)..(131): Xaa at position 131 is Tyr, Phe, Met, His, Ile, Leu, Val Ala, or Gly
  SITE (134)..(134): Xaa at position 134 is Val, Ala, Gly, Leu, or Ile
  SITE (135)..(135): Xaa at position 135 is Val, Ala, Gly, Leu, or Ile
  SITE (139)..(139): Xaa at position 139 is Ala, Gly, or Pro
  SITE (141)..(141): Xaa at position 141 is Ala, Gly, or Pro
  SITE (143)..(143): Xaa at position 143 is Ala, Gly, or Pro
MVHXTPEEKSAXTAXWGKVNVDEXGGEXXGRXXVVYPWTQRFFESFGDXSTPDAXMGNPKXKAHGKKVXGAXSDGLAHXDNXKGTXATLSELHXDKLHVDPENFRLLGNVXVCXXAHHXGKEFTPPXQAXXQKXXAGVXNXLXHKYH

SEQ ID NO: 607 - protein, 142 aa, Homo sapiens
  SITE (11)..(11): Xaa at position 11 is Val, Ala, Gly, Leu, or Ile
  SITE (13)..(13): Xaa at position 13 is Ala, Gly, or Pro
  SITE (14)..(14): Xaa at position 14 is Ala, Gly, or Pro
  SITE (15)..(15): Xaa at position 15 is Trp, Tyr, Phe, Met, His, Ile, Leu Val, Ala, or Gly
  SITE (18)..(18): Xaa at position 18 is Val, Ala, Gly, Leu, or Ile
  SITE (22)..(22): Xaa at position 22 is Ala, Gly, or Pro
  SITE (25)..(25): Xaa at position 25 is Tyr, Phe, Met, His, Ile, Leu, Val Ala, or Gly
  SITE (27)..(27): Xaa at position 27 is Ala, Gly, or Pro
  SITE (29)..(29): Xaa at position 29 is Ala, Gly, or Pro
  SITE (30)..(30): Xaa at position 30 is Leu, Ala, Val, Gly, or Ile
  SITE (33)..(33): Xaa at position 33 is Met, Ile, Leu, Val, Ala, or Gly
  SITE (34)..(34): Xaa at position 34 is Phe, Tyr, Met, His, Ile, Leu, Val Ala, or Gly
  SITE (56)..(56): Xaa at position 56 is Val, Ala, Gly, Leu, or Ile
  SITE (64)..(64): Xaa at position 64 is Ala, Gly, or Pro
  SITE (66)..(66): Xaa at position 66 is Ala, Gly, or Pro
  SITE (70)..(70): Xaa at position 70 is Ala, Gly, or Pro
  SITE (71)..(71): Xaa at position 71 is Val, Ala, Gly, Leu, or Ile
  SITE (74)..(74): Xaa at position 74 is Val, Ala, Gly, Leu, or Ile
  SITE (77)..(77): Xaa at position 77 is Met, Ile, Leu, Val, Ala, or Gly
  SITE (81)..(81): Xaa at position 81 is Leu, Ala, Val, Gly, or Ile
  SITE (89)..(89): Xaa at position 89 is Ala, Gly, or Pro
  SITE (105)..(105): Xaa at position 105 is Cys, Ala, Val, Gly, Ser, or Thr
  SITE (106)..(106): Xaa at position 106 is Leu, Ala, Val, Gly, or Ile
  SITE (108)..(108): Xaa at position 108 is Val, Ala, Gly, Leu, or Ile
  SITE (110)..(110): Xaa at position 110 is Leu, Ala, Val, Gly, or Ile
  SITE (114)..(114): Xaa at position 114 is Leu, Ala, Val, Gly, or Ile
  SITE (124)..(124): Xaa at position 124 is Ala, Gly, or Pro
  SITE (126)..(126): Xaa at position 126 is Leu, Ala, Val, Gly, or Ile
  SITE (129)..(129): Xaa at position 129 is Phe, Tyr, Met, His, Ile, Leu, Val Ala, or Gly
  SITE (130)..(130): Xaa at position 130 is Leu, Ala, Val, Gly, or Ile
  SITE (136)..(136): Xaa at position 136 is Val, Ala, Gly, Leu, or Ile
MVLSPADKTNXKXXXGKXGAHXGEXGXEXXERXXLSFPTTKTYFPHFDLSHGSAQXKGHGKKVXDXLTNXXAHXDDXPNAXSALSDLHXHKLRVDPVNFKLLSHXXLXTXAAHXPAEFTPAVHXSXDKXXASVSTXLTSKYR

SEQ ID NO: 608 - protein, 504 aa, Homo sapiens
  SITE (51)..(51): Xaa at position 51 is Ala, Gly, or Pro
  SITE (53)..(53): Xaa at position 53 is Leu, Ala, Val, Gly, or Ile
  SITE (55)..(55): Xaa at position 55 is Cys, Ala, Val, Gly, Ser, or Thr
  SITE (66)..(66): Xaa at position 66 is Ile, Ala, Val, Leu, or Gly
  SITE (68)..(68): Xaa at position 68 is Trp, Tyr, Phe, Met, His, Ile, Leu Val, Ala, or Gly
  SITE (106)..(106): Xaa at position 106 is Ile, Ala, Val, Leu, or Gly
  SITE (111)..(111): Xaa at position 111 is Ile, Ala, Val, Leu, or Gly
  SITE (121)..(121): Xaa at position 121 is Cys, Ala, Val, Gly, Ser, or Thr
  SITE (122)..(122): Xaa at position 122 is Val, Ala, Gly, Leu, or Ile
  SITE (168)..(168): Xaa at position 168 is Phe, Tyr, Met, His, Ile, Leu, Val Ala, or Gly
  SITE (170)..(170): Xaa at position 170 is Cys, Ala, Val, Gly, Ser, or Thr
  SITE (175)..(175): Xaa at position 175 is Phe, Tyr, Met, His, Ile, Leu, Val Ala, or Gly
  SITE (184)..(184): Xaa at position 184 is Trp, Tyr, Phe, Met, His, Ile, Leu Val, Ala, or Gly
  SITE (213)..(213): Xaa at position 213 is Ala, Gly, or Pro
  SITE (215)..(215): Xaa at position 215 is Val, Ala, Gly, Leu, or Ile
  SITE (217)..(217): Xaa at position 217 is Leu, Ala, Val, Gly, or Ile
  SITE (226)..(226): Xaa at position 226 is Val, Ala, Gly, Leu, or Ile
  SITE (228)..(228): Xaa at position 228 is Cys, Ala, Val, Gly, Ser, or Thr
  SITE (230)..(230): Xaa at position 230 is Val, Ala, Gly, Leu, or Ile
  SITE (246)..(246): Xaa at position 246 is Leu, Ala, Val, Gly, or Ile
  SITE (250)..(250): Xaa at position 250 is Ile, Ala, Val, Leu, or Gly
  SITE (271)..(271): Xaa at position 271 is Val, Ala, Gly, Leu, or Ile
  SITE (273)..(273): Xaa at position 273 is Cys, Ala, Val, Gly, Ser, or Thr
  SITE (275)..(275): Xaa at position 275 is Val, Ala, Gly, Leu, or Ile
  SITE (278)..(278): Xaa at position 278 is Phe, Tyr, Met, His, Ile, Leu, Val Ala, or Gly
  SITE (285)..(285): Xaa at position 285 is Leu, Ala, Val, Gly, or Ile
  SITE (287)..(287): Xaa at position 287 is Trp, Tyr, Phe, Met, His, Ile, Leu Val, Ala, or Gly
  SITE (331)..(331): Xaa at position 331 is Cys, Ala, Val, Gly, Ser, or Thr
  SITE (333)..(333): Xaa at position 333 is Val, Ala, Gly, Leu, or Ile
MEPAGPAPGRLGPLLCLLLAASCAWSGVAGEEELQVIQPDKSVLVAAGETXTXRXTATSLIPVGPXQXFRGAGPGRELIYNQKEGHFPRVTTVSDLTKRNNMDFSXRIGNXTPADAGTYYXXKFRKGSPDDVEFKSGAGTELSVRAKPSAPVVSGPAARATPQHTVSXTXESHGXSPRDITLKXFKNGNELSDFQTNVDPVGESVSYSIHSTXKXVXTREDVHSQXIXEXAHVTLQGDPLRGTANXSETXRVPPTLEVTQQPVRAENQVNXTXQXRKXYPQRLQXTXLENGNVSRTETASTVTENKDGTYNWMSWLLVNVSAHRDDVKLTXQXEHDGQPAVSKSHDLKVSAHPKEQGSNTAAENTGSNERNIYIVVGVVCTLLVALLMAALYLVRIRQKKAQGSTSSTRLHEPEKNAREITQDTNDITYADLNLPKGKKPAPQAAEPNNHTEYASIQTSPQPASEDTLTYADLDMVHLNRTPKQPAPKPEPSFSEYASVQVPRK

SEQ ID NO: 609 - protein, 2273 aa, Homo sapiens
  SITE (1968)..(1968): Xaa at position 1968 is Phe, Tyr, Met, His, Ile, Leu Val, Ala, or Gly
  SITE (1970)..(1970): Xaa at position 1970 is Leu, Ala, Val, Gly, or Ile
  SITE (1971)..(1971): Xaa at position 1971 is Leu, Ala, Val, Gly, or Ile
  SITE (1982)..(1982): Xaa at position 1982 is Phe, Tyr, Met, His, Ile, Leu Val, Ala, or Gly
MGFVRQIQLLLWKNWTLRKRQKIRFVVELVWPLSLFLVLIWLRNANPLYSHHECHFPNKAMPSAGMLPWLQGIFCNVNNPCFQSPTPGESPGIVSNYNNSILARVYRDFQELLMNAPESQHLGRIWTELHILSQFMDTLRTHPERIAGRGIRIRDILKDEETLTLFLIKNIGLSDSVVYLLINSQVRPEQFAHGVPDLALKDIACSEALLERFIIFSQRRGAKTVRYALCSLSQGTLQWIEDTLYANVDFFKLFRVLPTLLDSRSQGINLRSWGGILSDMSPRIQEFIHRPSMQDLLWVTRPLMQNGGPETFTKLMGILSDLLCGYPEGGGSRVLSFNWYEDNNYKAFLGIDSTRKDPIYSYDRRTTSFCNALIQSLESNPLTKIAWRAAKPLLMGKILYTPDSPAARRILKNANSTFEELEHVRKLVKAWEEVGPQIWYFFDNSTQMNMIRDTLGNPTVKDFLNRQLGEEGITAEAILNFLYKGPRESQADDMANFDWRDIFNITDRTLRLVNQYLECLVLDKFESYNDETQLTQRALSLLEENMFWAGVVFPDMYPWTSSLPPHVKYKIRMDIDVVEKTNKIKDRYWDSGPRADPVEDFRYIWGGFAYLQDMVEQGITRSQVQAEAPVGIYLQQMPYPCFVDDSFMIILNRCFPIFMVLAWIYSVSMTVKSIVLEKELRLKETLKNQGVSNAVIWCTWFLDSFSIMSMSIFLLTIFIMHGRILHYSDPFILFLFLLAFSTATIMLCFLLSTFFSKASLAAACSGVIYFTLYLPHILCFAWQDRMTAELKKAVSLLSPVAFGFGTEYLVRFEEQGLGLQWSNIGNSPTEGDEFSFLLSMQMMLLDAAVYGLLAWYLDQVFPGDYGTPLPWYFLLQESYWLGGEGCSTREERALEKTEPLTEETEDPEHPEGIHDSFFEREHPGWVPGVCVKNLVKIFEPCGRPAVDRLNITFYENQITAFLGHNGAGKTTTLSILTGLLPPTSGTVLVGGRDIETSLDAVRQSLGMCPQHNILFHHLTVAEHMLFYAQLKGKSQEEAQLEMEAMLEDTGLHHKRNEEAQDLSGGMQRKLSVAIAFVGDAKVVILDEPTSGVDPYSRRSIWDLLLKYRSGRTIIMSTHHMDEADLLGDRIAIIAQGRLYCSGTPLFLKNCFGTGLYLTLVRKMKNIQSQRKGSEGTCSCSSKGFSTTCPAHVDDLTPEQVLDGDVNELMDVVLHHVPEAKLVECIGQELIFLLPNKNFKHRAYASLFRELEETLADLGLSSFGISDTPLEEIFLKVTEDSDSGPLFAGGAQQKRENVNPRHPCLGPREKAGQTPQDSNVCSPGAPAAHPEGQPPPEPECPGPQLNTGTQLVLQHVQALLVKRFQHTIRSHKDFLAQIVLPATFVFLALMLSIVIPPFGEYPALTLHPWIYGQQYTFFSMDEPGSEQFTVLADVLLNKPGFGNRCLKEGWLPEYPCGNSTPWKTPSVSPNITQLFQKQKWTQVNPSPSCRCSTREKLTMLPECPEGAGGLPPPQRTQRSTEILQDLTDRNISDFLVKTYPALIRSSLKSKFWVNEQRYGGISIGGKLPVVPITGEALVGFLSDLGRIMNVSGGPITREASKEIPDFLKHLETEDNIKVWFNNKGWHALVSFLNVAHNAILRASLPKDRSPEEYGITVISQPLNLTKEQLSEITVLTTSVDAVVAICVIFSMSFVPASFVLYLIQERVNKSKHLQFISGVSPTTYWVTNFLWDIMNYSVSAGLVVGIFIGFQKKAYTSPENLPALVALLLLYGWAVIPMMYPASFLFDVPSTAYVALSCANLFIGINSSAITFILELFENNRTLLRFNAVLRKLLIVFPHFCLGRGLIDLALSQAVTDVYARFGEEHSANPFHWDLIGKNLFAMVVEGVVYFLLTLLVQRHFFLSQWIAEPTKEPIVDEDDDVAEERQRIITGGNKTDILRLHELTKIYPGTSSPAVDRLCVGVRPGECXGXXGVNGAGKTTTXKMLTGDTTVTSGDATVAGKSILTNISEVHQNMGYCPQFDAIDELLTGREHLYLYARLRGVPAEEIEKVANWSIKSLGLTVYADCLAGTYSGGNKRKLSTAIALIGCPPLVLLDEPTTGMDPQARRMLWNVIVSIIREGRAVVLTSHSMEECEALCTRLAIMVKGAFRCMGTIQHLKSKFGDGYIVTMKIKSPKDDLLPDLNPVEQFFQGNFPGSVQRERHYNMLQFQVSSSSLARIFQLLLSHKDSLLIEEYSVTQTTLDQVFVNFAKQQTESHDLPLHPRAAGASRQAQD

SEQ ID NO: 610 - protein, 273 aa, Homo sapiens
  SITE (155)..(155): Xaa at position 155 is Cys, Ala, Val, Gly, Ser, or Thr
  SITE (172)..(172): Xaa at position 172 is Cys, Ala, Val, Gly, Ser, or Thr
  SITE (179)..(179): Xaa at position 179 is Leu, Ala, Val, Gly, or Ile
  SITE (180)..(180): Xaa at position 180 is Leu, Ala, Val, Gly, or Ile
  SITE (182)..(182): Xaa at position 182 is Ile, Ala, Val, Leu, or Gly
  SITE (191)..(191): Xaa at position 191 is Ile, Ala, Val, Leu, or Gly
  SITE (195)..(195): Xaa at position 195 is Ile, Ala, Val, Leu, or Gly
  SITE (202)..(202): Xaa at position 202 is Phe, Tyr, Met, His, Ile, Leu, Val Ala, or Gly
  SITE (203)..(203): Xaa at position 203 is Trp, Tyr, Phe, Met, His, Ile, Leu Val, Ala, or Gly
  SITE (204)..(204): Xaa at position 204 is Met, Ile, Leu, Val, Ala, or Gly
  SITE (206)..(206): Xaa at position 206 is Leu, Ala, Val, Gly, or Ile
  SITE (243)..(243): Xaa at position 243 is Cys, Ala, Val, Gly, Ser, or Thr
  SITE (244)..(244): Xaa at position 244 is Ala, Gly, or Pro
  SITE (246)..(246): Xaa at position 246 is Ile, Ala, Val, Leu, or Gly
  SITE (251)..(251): Xaa at position 251 is Val, Ala, Gly, Leu, or Ile
  SITE (260)..(260): Xaa at position 260 is Ala, Gly, or Pro
  SITE (263)..(263): Xaa at position 263 is Ile, Ala, Val, Leu, or Gly
MTFDDLKIQTVKDQPDEKSNGKKAKGLQFLYSPWWCLAAATLGVLCLGLVVTIMVLGMQLSQVSDLLTQEQANLTHQKKKLEGQISARQQAEEASQESENELKEMIETLARKLNEKSKEQMELHHQNLNLQETLKRVANCSAPCPQDWIWHGENXYLFSSGSFNWEKSQEKXLSLDAKXXKXNSTADLDFXQQAXSYSSFPXXXGXSRRNPSYPWLWEDGSPLMPHLFRVRGAVSQTYPSGTXXYXQRGAXYAENCILAXFSXCQKKANLRAQ

SEQ ID NO: 611 - protein, 1218 aa, Homo sapiens
  SITE (35)..(35): Xaa at position 35 is Phe, Tyr, Met, His, Ile, Leu, Val Ala, or Gly
  SITE (37)..(37): Xaa at position 37 is Leu, Ala, Val, Gly, or Ile
  SITE (71)..(71): Xaa at position 71 is Cys, Ala, Val, Gly, Ser, or Thr
  SITE (75)..(75): Xaa at position 75 is Phe, Tyr, Met, His, Ile, Leu, Val Ala, or Gly
  SITE (79)..(79): Xaa at position 79 is Leu, Ala, Val, Gly, or Ile
  SITE (132)..(132): Xaa at position 132 is Tyr, Phe, Met, His, Ile, Leu, Val Ala, or Gly
  SITE (134)..(134): Xaa at position 134 is Leu, Ala, Val, Gly, or Ile
  SITE (136)..(136): Xaa at position 136 is Val, Ala, Gly, Leu, or Ile
  SITE (138)..(138): Xaa at position 138 is Ala, Gly, or Pro
  SITE (161)..(161): Xaa at position 161 is Ile, Ala, Val, Leu, or Gly
  SITE (177)..(177): Xaa at position 177 is Ala, Gly, or Pro
  SITE (179)..(179): Xaa at position 179 is Phe, Tyr, Met, His, Ile, Leu, Val Ala, or Gly
  SITE (183)..(183): Xaa at position 183 is Ile, Ala, Val, Leu, or Gly
  SITE (185)..(185): Xaa at position 185 is Val, Ala, Gly, Leu, or Ile
  SITE (196)..(196): Xaa at position 196 is Cys, Ala, Val, Gly, Ser, or Thr
  SITE (200)..(200): Xaa at position 200 is Cys, Ala, Val, Gly, Ser, or Thr
  SITE (229)..(229): Xaa at position 229 is Cys, Ala, Val, Gly, Ser, or Thr
  SITE (262)..(262): Xaa at position 262 is Cys, Ala, Val, Gly, Ser, or Thr
  SITE (265)..(265): Xaa at position 265 is Cys, Ala, Val, Gly, Ser, or Thr
  SITE (293)..(293): Xaa at position 293 is Cys, Ala, Val, Gly, Ser, or Thr
  SITE (324)..(324): Xaa at position 324 is Cys, Ala, Val, Gly, Ser, or Thr
  SITE (333)..(333): Xaa at position 333 is Cys, Ala, Val, Gly, Ser, or Thr
  SITE (522)..(522): Xaa at position 522 is Cys, Ala, Val, Gly, Ser, or Thr
  SITE (560)..(560): Xaa at position 560 is Cys, Ala, Val, Gly, Ser, or Thr
  SITE (664)..(664): Xaa at position 664 is Cys, Ala, Val, Gly, Ser, or Thr
MRSPRTRGRSGRPLSLLLALLCALRAKVCGASGQXEXEILSMQNVNGELQNGNCCGGARNPGDRKCTRDEXDTYXKVCXKEYQSRVTAGGPCSFGSGSTPVIGGNTFNLKASRGNDRNRIVLPFSFAWPRSXTXLXEXWDSSNDTVQPDSIIEKASHSGMXNPSRQWQTLKQNTGVXHXEYQXRXTCDDYYYGFGXNKFXRPRDDFFGHYACDQNGNKTCMEGWMGPEXNRAICRQGCSPKHGSCKLPGDCRCQYGWQGLYXDKXIPHPGCVHGICNEPWQCLCETNWGGQLXDKDLNYCGTHQPCLNGGTCSNTGPDKYQCSXPEGYSGPNXEIAEHACLSDPCHNRGSCKETSLGFECECSPGWTGPTCSTNIDDCSPNNCSHGGTCQDLVNGFKCVCPPQWTGKTCQLDANECEAKPCVNAKSCKNLIASYYCDCLPGWMGQNCDININDCLGQCQNDASCRDLVNGYRCICPPGYAGDHCERDIDECASNPCLNGGHCQNEINRFQCLCPTGFSGNLXQLDIDYCEPNPCQNGAQCYNRASDYFCKCPEDYEGKNXSHLKDHCRTTPCEVIDSCTVAMASNDTPEGVRYISSNVCGPHGKCKSQSGGKFTCDCNKGFTGTYCHENINDCESNPCRNGGTCIDGVNSYKCICSDGWEGAYXETNINDCSQNPCHNGGTCRDLVNDFYCDCKNGWKGKTCHSRDSQCDEATCNNGGTCYDEGDAFKCMCPGGWEGTTCNIARNSSCLPNPCHNGGTCVVNGESFTCVCKEGWEGPICAQNTNDCSPHPCYNSGTCVDGDNWYRCECAPGFAGPDCRININECQSSPCAFGATCVDEINGYRCVCPPGHSGAKCQEVSGRPCITMGSVIPDGAKWDDDCNTCQCLNGRIACSKVWCGPRPCLLHKGHSECPSGQSCIPILDDQCFVHPCTGVGECRSSSLQPVKTKCTSDSYYQDNCANITFTFNKEMMSPGLTTEHICSELRNLNILKNVSAEYSIYIACEPSPSANNEIHVAISAEDIRDDGNPIKEITDKIIDLVSKRDGNSSLIAAVAEVRVQRRPLKNRTDFLVPLLSSVLTVAWICCLVTAFYWCLRKRRKPGSHTHSASEDNTTNNVREQLNQIKNPIEKHGANTVPIKDYENKNSKMSKIRTHNSEVEEDDMDKHQQKARFAKQPAYTLVDREEKPPNGTPTKHPNWTNKQDNRDLESAQSLNRMEYIV

SEQ ID NO: 612 - protein, 3460 aa, Homo sapiens
  SITE (674)..(674): Xaa at position 674 is Cys, Ala, Val, Gly, Ser, or Thr
  SITE (700)..(700): Xaa at position 700 is Cys, Ala, Val, Gly, Ser, or Thr
  SITE (1772)..(1772): Xaa at position 1772 is Cys, Ala, Val, Gly, Ser, or Thr
  SITE (1794)..(1794): Xaa at position 1794 is Cys, Ala, Val, Gly, Ser, or Thr
  SITE (2485)..(2485): Xaa at position 2485 is Cys, Ala, Val, Gly, Ser, or Thr
  SITE (2507)..(2507): Xaa at position 2507 is Cys, Ala, Val, Gly, Ser, or Thr
MERSGWARQTFLLALLLGATLRARAAAGYYPRFSPFFFLCTHHGELEGDGEQGEVLISLHIAGNPTYYVPGQEYHVTISTSTFFDGLLVTGLYTSTSVQASQSIGGSSAFGFGIMSDHQFGNQFMCSVVASHVSHLPTTNLSFIWIAPPAGTGCVNFMATATHRGQVIFKDALAQQLCEQGAPTDVTVHPHLAEIHSDSIILRDDFDSYHQLQLNPNIWVECNNCETGEQCGAIMHGNAVTFCEPYGPRELITTGLNTTTASVLQFSIGSGSCRFSYSDPSIIVLYAKNNSADWIQLEKIRAPSNVSTIIHILYLPEDAKGENVQFQWKQENLRVGEVYEACWALDNILIINSAHRQVVLEDSLDPVDTGNWLFFPGATVKHSCQSDGNSIYFHGNEGSEFNFATTRDVDLSTEDIQEQWSEEFESQPTGWDVLGAVIGTECGTIESGLSMVFLKDGERKLCTPSMDTTGYGNLRFYFVMGGICDPGNSHENDIILYAKIEGRKEHITLDTLSYSSYKVPSLVSVVINPELQTPATKFCLRQKNHQGHNRNVWAVDFFHVLPVLPSTMSHMIQFSINLGCGTHQPGNSVSLEFSTNHGRSWSLLHTECLPEICAGPHLPHSTVYSSENYSGWNRITIPLPNAALTRNTRIRWRQTGPILGNMWAIDNVYIGPSXLKFCSGRGQCTRHGCKCDPGFSGPAXEMASQTFPMFISESFGSSRLSSYHNFYSIRGAEVSFGCGVLASGKALVFNKDGRRQLITSFLDSSQSRFLQFTLRLGSKSVLSTCRAPDQPGEGVLLHYSYDNGITWKLLEHYSYLSYHEPRIISVELPGDAKQFGIQFRWWQPYHSSQREDVWAIDEIIMTSVLFNSISLDFTNLVEVTQSLGFYLGNVQPYCGHDWTLCFTGDSKLASSMRYVETQSMQIGASYMIQFSLVMGCGQKYTPHMDNQVKLEYSTNHGLTWHLVQEECLPSMPSCQEFTSASIYHASEFTQWRRVIVLLPQKTWSSATRFRWSQSYYTAQDEWALDSIYIGQQCPNMCSGHGSCDHGICRCDQGYQGTECHPEAALPSTIMSDFENQNGWESDWQEVIGGEIVKPEQGCGVISSGSSLYFSKAGKRQLVSWDLDTSWVDFVQFYIQIGGESASCNKPDSREEGVLLQYSNNGGIQWHLLAEMYFSDFSKPRFVYLELPAAAKTPCTRFRWWQPVFSGEDYDQWAVDDIIILSEKQKQIIPVINPTLPQNFYEKPAFDYPMNQMSVWLMLANEGMVKNETFCAATPSAMIFGKSDGDRFAVTRDLTLKPGYVLQFKLNIGCANQFSSTAPVLLQYSHDAGMSWFLVKEGCYPASAGKGCEGNSRELSEPTMYHTGDFEEWTRITIVIPRSLASSKTRFRWIQESSSQKNVPPFGLDGVYISEPCPSYCSGHGDCISGVCFCDLGYTAAQGTCVSNVPNHNEMFDRFEGKLSPLWYKITGAQVGTGCGTLNDGKSLYFNGPGKREARTVPLDTRNIRLVQFYIQIGSKTSGITCIKPRTRNEGLIVQYSNDNGILWHLLRELDFMSFLEPQIISIDLPQDAKTPATAFRWWQPQHGKHSAQWALDDVLIGMNDSSQTGFQDKFDGSIDLQANWYRIQGGQVDIDCLSMDTALIFTENIGKPRYAETWDFHVSASTFLQFEMSMGCSKPFSNSHSVQLQYSLNNGKDWHLVTEECVPPTIGCLHYTESSIYTSERFQNWKRITVYLPLSTISPRTRFRWIQANYTVGADSWAIDNVVLASGCPWMXSGRGICDAGRCVCDRGFGGPYXVPVVPLPSILKDDFNGNLHPDLWPEVYGAERGNLNGETIKSGTSLIFKGEGLRMLISRDLDCTNTMYVQFSLRFIAKSTPERSHSILLQFSISGGITWHLMDEFYFPQTTNILFINVPLPYTAQTNATRFRLWQPYNNGKKEEIWIVDDFIIDGNNVNNPVMLLDTFDFGPREDNWFFYPGGNIGLYCPYSSKGAPEEDSAMVFVSNEVGEHSITTRDLNVNENTIIQFEINVGCSTDSSSADPVRLEFSRDFGATWHLLLPLCYHSSSHVSSLCSTEHHPSSTYYAGTMQGWRREVVHFGKLHLCGSVRFRWYQGFYPAGSQPVTWAIDNVYIGPQCEEMCNGQGSCINGTKCICDPGYSGPTCKISTKNPDFLKDDFEGQLESDRFLLMSGGKPSRKCGILSSGNNLFFNEDGLRMLMTRDLDLSHARFVQFFMRLGCGKGVPDPRSQPVLLQYSLNGGLSWSLLQEFLFSNSSNVGRYIALEIPLKARSGSTRLRWWQPSENGHFYSPWVIDQILIGGNISGNTVLEDDFTTLDSRKWLLHPGGTKMPVCGSTGDALVFIEKASTRYVVSTDVAVNEDSFLQIDFAASCSVTDSCYAIELEYSVDLGLSWHPLVRDCLPTNVECSRYHLQRILVSDTFNKWTRITLPLPPYTRSQATRFRWHQPAPFDKQQTWAIDNVYIGDGCIDMXSGHGRCIQGNCVCDEQWGGLYXDDPETSLPTQLKDNFNRAPSSQNWLTVNGGKLSTVCGAVASGMALHFSGGCSRLLVTVDLNLTNAEFIQFYFMYGCLITPNNRNQGVLLEYSVNGGITWNLLMEIFYDQYSKPGFVNILLPPDAKEIATRFRWWQPRHDGLDQNDWAIDNVLISGSADQRTVMLDTFSSAPVPQHERSPADAGPVGRIAFDMFMEDKTSVNEHWLFHDDCTVERFCDSPDGVMLCGSHDGREVYAVTHDLTPTEGWIMQFKISVGCKVSEKIAQNQIHVQYSTDFGVSWNYLVPQCLPADPKCSGSVSQPSVFFPTKGWKRITYPLPESLVGNPVRFRFYQKYSDMQWAIDNFYLGPGCLDNCRGHGDCLREQCICDPGYSGPNCYLTHTLKTFLKERFDSEEIKPDLWMSLEGGSTCTECGILAEDTALYFGGSTVRQAVTQDLDLRGAKFLQYWGRIGSENNMTSCHRPICRKEGVLLDYSTDGGITWTLLHEMDYQKYISVRHDYILLPEDALTNTTRLRWWQPFVISNGIVVSGVERAQWALDNILIGGAEINPSQLVDTFDDEGTSHEENWSFYPNAVRTAGFCGNPSFHLYWPNKKKDKTHNALSSRELIIQPGYMMQFKIVVGCEATSCGDLHSVMLEYTKDARSDSWQLVQTQCLPSSSNSIGCSPFQFHEATIYNSVNSSSWKRITIQLPDHVSSSATQFRWIQKGEETEKQSWAIDHVYIGEACPKLCSGHGYCTTGAICICDESFQGDDCSVFSHDLPSYIKDNFESARVTEANWETIQGGVIGSGCGQLAPYAHGDSLYFNGCQIRQAATKPLDLTRASKIMFVLQIGSMSQTDSCNSDLSGPHAVDKAVLLQYSVNNGITWHVIAQHQPKDFTQAQRVSYNVPLEARMKGVLLRWWQPRHNGTGHDQWALDHVEVVLVSTRKQNYMMNFSRQHGLRHFYNRRRRSLRRYP

SEQ ID NO: 613 - protein, 371 aa, Homo sapiens
  SITE (72)..(72): Xaa at position 72 is Val, Ala, Gly, Leu, or Ile
  SITE (75)..(75): Xaa at position 75 is Trp, Tyr, Phe, Met, His, Ile, Leu Val, Ala, or Gly
  SITE (76)..(76): Xaa at position 76 is Ile, Ala, Val, Leu, or Gly
  SITE (95)..(95): Xaa at position 95 is Cys, Ala, Val, Gly, Ser, or Thr
  SITE (102)..(102): Xaa at position 102 is Leu, Ala, Val, Gly, or Ile
  SITE (110)..(110): Xaa at position 110 is Leu, Ala, Val, Gly, or Ile
  SITE (114)..(114): Xaa at position 114 is Phe, Tyr, Met, His, Ile, Leu, Val Ala, or Gly
  SITE (121)..(121): Xaa at position 121 is Leu, Ala, Val, Gly, or Ile
  SITE (279)..(279): Xaa at position 279 is Ile, Ala, Val, Leu, or Gly
  SITE (303)..(303): Xaa at position 303 is Phe, Tyr, Met, His, Ile, Leu, Val Ala, or Gly
  SITE (305)..(305): Xaa at position 305 is Phe, Tyr, Met, His, Ile, Leu, Val Ala, or Gly
  SITE (311)..(311): Xaa at position 311 is Val, Ala, Gly, Leu, or Ile
  SITE (312)..(312): Xaa at position 312 is Ala, Gly, or Pro
  SITE (329)..(329): Xaa at position 329 is Leu, Ala, Val, Gly, or Ile
  SITE (333)..(333): Xaa at position 333 is Met, Ile, Leu, Val, Ala, or Gly
  SITE (342)..(342): Xaa at position 342 is Leu, Ala, Val, Gly, or Ile
  SITE (354)..(354): Xaa at position 354 is Phe, Tyr, Met, His, Ile, Leu, Val Ala, or Gly
MAATCEISNIFSNYFSAMYSSEDSTLASVPPAATFGADDLVLTLSNPQMSLEGTEKASWLGEQPQFWSKTQXLDXXSYQVEKNKYDASAIDFSRXDMDGATXCNCALEEXRLVXGPLGDQXHAQLRDLTSSSSDELSWIIELLEKDGMAFQEALDPGPFDQGSPFAQELLDDGQQASPYHPGSCGAGAPSPGSSDVSTAGTGASRSSHSSDSGGSDVDLDPTDGKLFPSDGFRDCKKGDPKHGKRKRGRPRKLSKEYWDCLEGKKSKHAPRGTHLWEFXRDILIHPELNEGLMKWENRHEGVXKXLRSEAXXQLWGQKKKNSNMTYEKXSRAXRYYYKREIXERVDGRRLVYKXGKNSSGWKEEEVLQSRN

SEQ ID NO: 614 - protein, 99 aa, Homo sapiens
  SITE (34)..(34): Xaa at position 34 is Cys, Ala, Val, Gly, Ser, or Thr
  SITE (35)..(35): Xaa at position 35 is Cys, Ala, Val, Gly, Ser, or Thr
  SITE (59)..(59): Xaa at position 59 is Cys, Ala, Val, Gly, Ser, or Thr
  SITE (63)..(63): Xaa at position 63 is Ala, Gly, or Pro
  SITE (64)..(64): Xaa at position 64 is Val, Ala, Gly, Leu, or Ile
  SITE (65)..(65): Xaa at position 65 is Ile, Ala, Val, Leu, or Gly
  SITE (66)..(66): Xaa at position 66 is Phe, Tyr, Met, His, Ile, Leu, Val Ala, or Gly
  SITE (74)..(74): Xaa at position 74 is Ile, Ala, Val, Leu, or Gly
  SITE (76)..(76): Xaa at position 76 is Ala, Gly, or Pro
  SITE (83)..(83): Xaa at position 83 is Val, Ala, Gly, Leu, or Ile
  SITE (86)..(86): Xaa at position 86 is Phe, Tyr, Met, His, Ile, Leu, Val Ala, or Gly
MKASAALLCLLLTAAAFSPQGLAQPVGINTSTTXXYRFINKKIPKQRLESYRRTTSSHXPREXXXXKTKLDKEXCXDPTQKWXQDXMKHLDKKTQTPKL

SEQ ID NO: 615 - protein, 1406 aa, Homo sapiens
  SITE (107)..(107): Xaa at position 107 is Cys, Ala, Val, Gly, Ser, or Thr
  SITE (221)..(221): Xaa at position 221 is Cys, Ala, Val, Gly, Ser, or Thr
  SITE (336)..(336): Xaa at position 336 is Cys, Ala, Val, Gly, Ser, or Thr
  SITE (1332)..(1332): Xaa at position 1332 is Cys, Ala, Val, Gly, Ser, or Thr
MALKNINYLLIFYLSFSLLIYIKNSFCNKNNTRCLSNSCQNNSTCKDFSKDNDCSCSDTANNLDKDCDNMKDPCFSNPCQGSATCVNTPGERSFLCKCPPGYSGTIXETTIGSCGKNSCQHGGICHQDPIYPVCICPAGYAGRFCEIDHDECASSPCQNGAVCQDGIDGYSCFCVPGYQGRHCDLEVDECASDPCKNEATCLNEIGRYTCICPHNYSGVNXELEIDECWSQPCLNGATCQDALGAYFCDCAPGFLGDHCELNTDECASQPCLHGGLCVDGENRYSCNCTGSGFTGTHCETLMPLCWSKPCHNNATCEDSVDNYTCHCWPGYTGAQXEIDLNECNSNPCQSNGECVELSSEKQYGRITGLPSSFSYHEASGYVCICQPGFTGIHCEEDVNECSSNPCQNGGTCENLPGNYTCHCPFDNLSRTFYGGRDCSDILLGCTHQQCLNNGTCIPHFQDGQHGFSCLCPSGYTGSLCEIATTLSFEGDGFLWVKSGSVTTKGSVCNIALRFQTVQPMALLLFRSNRDVFVKLELLSGYIHLSIQVNNQSKVLLFISHNTSDGEWHFVEVIFAEAVTLTLIDDSCKEKCIAKAPTPLESDQSICAFQNSFLGGLPVGMTSNGVALLNFYNMPSTPSFVGCLQDIKIDWNHITLENISSGSSLNVKAGCVRKDWCESQPCQSRGRCINLWLSYQCDCHRPYEGPNCLREYVAGRFGQDDSTGYVIFTLDESYGDTISLSMFVRTLQPSGLLLALENSTYQYIRVWLERGRLAMLTPNSPKLVVKFVLNDGNVHLISLKIKPYKIELYQSSQNLGFISASTWKIEKGDVIYIGGLPDKQETELNGGFFKGCIQDVRLNNQNLEFFPNPTNNASLNPVLVNVTQGCAGDNSCKSNPCHNGGVCHSRWDDFSCSCPALTSGKACEEVQWCGFSPCPHGAQCQPVLQGFECIANAVFNGQSGQILFRSNGNITRELTNITFGFRTRDANVIILHAEKEPEFLNISIQDSRLFFQLQSGNSFYMLSLTSLQSVNDGTWHEVTLSMTDPLSQTSRWQMEVDNETPFVTSTIATGSLNFLKDNTDIYVGDRAIDNIKGLQGCLSTIEIGGIYLSYFENVHGFINKPQEEQFLKISTNSVVTGCLQLNVCNSNPCLHGGNCEDIYSSYHCSCPLGWSGKHCELNIDECFSNPCIHGNCSDRVAAYHCTCEPGYTGVNCEVDIDNCQSHQCANGATCISHTNGYSCLCFGNFTGKFCRQSRLPSTVCGNEKTNLTCYNGGNCTEFQTELKCMCRPGFTGEWCEKDIDECASDPCVNGGLCQDLLNKFQCLCDVAFAGERXEVDLADDLISDIFTTIGSVTVALLLILLLAIVASVVTSNKRATQGTYSPSRQEKEGSRVEMWNLMPPPAMERLI

SEQ ID NO: 616 - protein, 425 aa, Homo sapiens
  SITE (12)..(12): Xaa at position 12 is Val, Ala, Gly, Leu, or Ile
  SITE (15)..(15): Xaa at position 15 is Leu, Ala, Val, Gly, or Ile
  SITE (34)..(34): Xaa at position 34 is Ala, Gly, or Pro
  SITE (35)..(35): Xaa at position 35 is Val, Ala, Gly, Leu, or Ile
  SITE (38)..(38): Xaa at position 38 is Leu, Ala, Val, Gly, or Ile
  SITE (39)..(39): Xaa at position 39 is Val, Ala, Gly, Leu, or Ile
  SITE (42)..(42): Xaa at position 42 is Leu, Ala, Val, Gly, or Ile
  SITE (54)..(54): Xaa at position 54 is Ala, Gly, or Pro
  SITE (55)..(55): Xaa at position 55 is Ile, Ala, Val, Leu, or Gly
  SITE (65)..(65): Xaa at position 65 is Ile, Ala, Val, Leu, or Gly
  SITE (67)..(67): Xaa at position 67 is Ile, Ala, Val, Leu, or Gly
  SITE (77)..(77): Xaa at position 77 is Val, Ala, Gly, Leu, or Ile
  SITE (88)..(88): Xaa at position 88 is Tyr, Phe, Met, His, Ile, Leu, Val Ala, or Gly
  SITE (89)..(89): Xaa at position 89 is Cys, Ala, Val, Gly, Ser, or Thr
  SITE (109)..(109): Xaa at position 109 is Cys, Ala, Val, Gly, Ser, or Thr
  SITE (112)..(112): Xaa at position 112 is Ala, Gly, or Pro
  SITE (120)..(120): Xaa at position 120 is Val, Ala, Gly, Leu, or Ile
  SITE (121)..(121): Xaa at position 121 is Cys, Ala, Val, Gly, Ser, or Thr
  SITE (122)..(122): Xaa at position 122 is Val, Ala, Gly, Leu, or Ile
  SITE (126)..(126): Xaa at position 126 is His, Phe, Tyr, Lys, Arg, Gly, Ser Thr, Ala, Val, Leu, Ile, Asn, Met, or Gln
  SITE (127)..(127): Xaa at position 127 is Tyr, Phe, Met, His, Ile, Leu, Val Ala, or Gly
  SITE (130)..(130): Xaa at position 130 is Val, Ala, Gly, Leu, or Ile
  SITE (233)..(233): Xaa at position 233 is Cys, Ala, Val, Gly, Ser, or Thr
  SITE (235)..(235): Xaa at position 235 is Ile, Ala, Val, Leu, or Gly
  SITE (237)..(237): Xaa at position 237 is Tyr, Phe, Met, His, Ile, Leu, Val Ala, or Gly
  SITE (244)..(244): Xaa at position 244 is Val, Ala, Gly, Leu, or Ile
  SITE (250)..(250): Xaa at position 250 is Ala, Gly, or Pro
  SITE (255)..(255): Xaa at position 255 is Met, Ile, Leu, Val, Ala, or Gly
  SITE (257)..(257): Xaa at position 257 is Val, Ala, Gly, Leu, or Ile
  SITE (271)..(271): Xaa at position 271 is Leu, Ala, Val, Gly, or Ile
  SITE (283)..(283): Xaa at position 283 is Val, Ala, Gly, Leu, or Ile
  SITE (290)..(290): Xaa at position 290 is Ile, Ala, Val, Leu, or Gly
  SITE (294)..(294): Xaa at position 294 is Val, Ala, Gly, Leu, or Ile
  SITE (296)..(296): Xaa at position 296 is Leu, Ala, Val, Gly, or Ile
  SITE (303)..(303): Xaa at position 303 is Val, Ala, Gly, Leu, or Ile
  SITE (305)..(305): Xaa at position 305 is Ala, Gly, or Pro
  SITE (307)..(307): Xaa at position 307 is Cys, Ala, Val, Gly, Ser, or Thr
  SITE (313)..(313): Xaa at position 313 is Ile, Ala, Val, Leu, or Gly
  SITE (315)..(315): Xaa at position 315 is Val, Ala, Gly, Leu, or Ile
  SITE (320)..(320): Xaa at position 320 is Cys, Ala, Val, Gly, Ser, or Thr
  SITE (334)..(334): Xaa at position 334 is Ile, Ala, Val, Leu, or Gly
  SITE (342)..(342): Xaa at position 342 is Ile, Ala, Val, Leu, or Gly
  SITE (343)..(343): Xaa at position 343 is Phe, Tyr, Met, His, Ile, Leu, Val Ala, or Gly
  SITE (348)..(348): Xaa at position 348 is Phe, Tyr, Met, His, Ile, Leu, Val Ala, or Gly
  SITE (363)..(363): Xaa at position 363 is Val, Ala, Gly, Leu, or Ile
  SITE (370)..(370): Xaa at position 370 is Cys, Ala, Val, Gly, Ser, or Thr
  SITE (372)..(372): Xaa at position 372 is Ile, Ala, Val, Leu, or Gly
  SITE (374)..(374): Xaa at position 374 is Met, Ile, Leu, Val, Ala, or Gly
  SITE (376)..(376): Xaa at position 376 is Phe, Tyr, Met, His, Ile, Leu, Val Ala, or Gly
  SITE (380)..(380): Xaa at position 380 is Trp, Tyr, Phe, Met, His, Ile, Leu Val, Ala, or Gly
  SITE (394)..(394): Xaa at position 394 is Cys, Ala, Val, Gly, Ser, or Thr
  SITE (396)..(396): Xaa at position 396 is Ile, Ala, Val, Leu, or Gly
  SITE (398)..(398): Xaa at position 398 is Leu, Ala, Val, Gly, or Ile
  SITE (400)..(400): Xaa at position 400 is Leu, Ala, Val, Gly, or Ile
  SITE (407)..(407): Xaa at position 407 is Leu, Ala, Val, Gly, or Ile
MSSILPFTPPIXKRXLGWKKGEQNGQEEKWCEKXXKSXXKKXKKTGQLDELEKXXTTQNVNTKCXTXPRSLDGRLQXSHRKGLPHVIXXRLWRWPDLHSHHELRAMELXEFXFNMKKDEXXXNPYXXQRXETPVLPPVLVPRHTEIPAEFPPLDDYSHSIPENTNFPAGIEPQSNIPETPPPGYLSEDGETSDHQMNHSMDAGSPNLSPNPMSPAHNNLDLQPVTYCEPAFWXSXSXYELNQRXGETFHXSQPSXTXDGFTDPSNSERFCXGLLSNVNRNAAXELTRRHXGRGXRXYYIGGEXFXEXLSDSAXFXQSPNXNQRYGWHPATVCKXPPGCNLKXXNNQEXAALLAQSVNQGFEAXYQLTRMXTXRXSXVKGXGAEYRRQTVTSTPXWXEXHXNGPLQWXDKVLTQMGSPSIRCSSVS

SEQ ID NO: 617 - protein, 770 aa, Homo sapiens
  SITE (124)..(124): Xaa at position 124 is Ile, Ala, Val, Leu, or Gly
  SITE (155)..(155): Xaa at position 155 is Ala, Gly, or Pro
  SITE (168)..(168): Xaa at position 168 is Val, Ala, Gly, Leu, or Ile
MSNEVETSATNGQPDQQAAPKAPSKKEKKKGPEKTDEYLLARFKGDGVKYKAKLIGIDDVPDARGDKMSQDSMMKLKGMAAAGRSQGQHKQRIWVNISLSGIKIIDEKTGVIEHEHPVNKISFXARDVTDNRAFGYVCGGEGQHQFFAIKTGQQXEPLVVDLKDLFQXIYNVKKKEEEKKKIEEASKAVENGSEALMILDDQTNKLKSGVDQMDLFGDMSTPPDLNSPTESKDILLVDLNSEIDTNQNSLRENPFLTNGITSCSLPRPTPQASFLPENAFSANLNFFPTPNPDPFRDDPFTQPDQSTPSSFDSLKSPDQKKENSSSSSTPLSNGPLNGDVDYFGQQFDQISNRTGKQEAQAGPWPFSSSQTQPAVRTQNGVSEREQNGFSVKSSPNPFVGSPPKGLSIQNGVKQDLESSVQSSPHDSIAIIPPPQSTKPGRGRRTAKSSANDLLASDIFAPPVSEPSGQASPTGQPTALQPNPLDLFKTSAPAPVGPLVGLGGVTVTLPQAGPWNTASLVFNQSPSMAPGAMMGGQPSGFSQPVIFGTSPAVSGWNQPSPFAASTPPPVPVVWGPSASVAPNAWSTTSPLGNPFQSNIFPAPAVSTQPPSMHSSLLVTPPQPPPRAGPPKDISSDAFTALDPLGDKEIKDVKEMFKDFQLRQPPAVPARKGEQTSSGTLSAFASYFNSKVGIPQENADHDDFDANQLLNKINEPPKPAPRQVSLPVTKSTDNAFENPFFKDSFGSSQASVASSQPVSSEMYRDPFGNPFA

SEQ ID NO: 618 - protein, 4391 aa, Homo sapiens
  SITE (4204)..(4204): Xaa at position 4204 is Ala, Gly, or Pro
  SITE (4206)..(4206): Xaa at position 4206 is Phe, Tyr, Met, His, Ile, Leu Val, Ala, or Gly
  SITE (4214)..(4214): Xaa at position 4214 is Phe, Tyr, Met, His, Ile, Leu Val, Ala, or Gly
  SITE (4219)..(4219): Xaa at position 4219 is Phe, Tyr, Met, His, Ile, Leu Val, Ala, or Gly
  SITE (4230)..(4230): Xaa at position 4230 is Ile, Ala, Val, Leu, or Gly
  SITE (4232)..(4232): Xaa at position 4232 is Leu, Ala, Val, Gly, or Ile
  SITE (4234)..(4234): Xaa at position 4234 is Val, Ala, Gly, Leu, or Ile
  SITE (4242)..(4242): Xaa at position 4242 is Leu, Ala, Val, Gly, or Ile
  SITE (4243)..(4243): Xaa at position 4243 is Leu, Ala, Val, Gly, or Ile
  SITE (4244)..(4244): Xaa at position 4244 is Leu, Ala, Val, Gly, or Ile
  SITE (4259)..(4259): Xaa at position 4259 is Phe, Tyr, Met, His, Ile, Leu Val, Ala, or Gly
  SITE (4260)..(4260): Xaa at position 4260 is Ile, Ala, Val, Leu, or Gly
  SITE (4262)..(4262): Xaa at position 4262 is Leu, Ala, Val, Gly, or Ile
  SITE (4264)..(4264): Xaa at position 4264 is Leu, Ala, Val, Gly, or Ile
  SITE (4269)..(4269): Xaa at position 4269 is Leu, Ala, Val, Gly, or Ile
  SITE (4270)..(4270): Xaa at position 4270 is Val, Ala, Gly, Leu, or Ile
  SITE (4273)..(4273): Xaa at position 4273 is Tyr, Phe, Met, His, Ile, Leu Val, Ala, or Gly
  SITE (4275)..(4275): Xaa at position 4275 is Leu, Ala, Val, Gly, or Ile
  SITE (4280)..(4280): Xaa at position 4280 is Ala, Gly, or Pro
  SITE (4296)..(4296): Xaa at position 4296 is Val, Ala, Gly, Leu, or Ile
  SITE (4298)..(4298): Xaa at position 4298 is Ala, Gly, or Pro
  SITE (4307)..(4307): Xaa at position 4307 is Ile, Ala, Val, Leu, or Gly
  SITE (4332)..(4332): Xaa at position 4332 is Val, Ala, Gly, Leu, or Ile
  SITE (4334)..(4334): Xaa at position 4334 is Ile, Ala, Val, Leu, or Gly
  SITE (4355)..(4355): Xaa at position 4355 is Cys, Ala, Val, Gly, Ser, or Thr
  SITE (4356)..(4356): Xaa at position 4356 is Val, Ala, Gly, Leu, or Ile
  SITE (4359)..(4359): Xaa at position 4359 is Leu, Ala, Val, Gly, or Ile
  SITE (4376)..(4376): Xaa at position 4376 is Leu, Ala, Val, Gly, or Ile
MGWRAAGALLLALLLHGRLLAVTHGLRAYDGLSLPEDIETVTASQMRWTHSYLSDDEDMLADSISGDDLGSGDLGSGDFQMVYFRALVNFTRSIEYSPQLEDAGSREFREVSEAVVDTLESEYLKIPGDQVVSVVFIKELDGWVFVELDVGSEGNADGAQIQEMLLRVISSGSVASYVTSPQGFQFRRLGTVPQFPRACTEAEFACHSYNECVALEYRCDRRPDCRDMSDELNCEEPVLGISPTFSLLVETTSLPPRPETTIMRQPPVTHAPQPLLPGSVRPLPCGPQEAACRNGHCIPRDYLCDGQEDCEDGSDELDCGPPPPCEPNEFPCGNGHCALKLWRCDGDFDCEDRTDEANCPTKRPEEVCGPTQFRCVSTNMCIPASFHCDEESDCPDRSDEFGCMPPQVVTPPRESIQASRGQTVTFTCVAIGVPTPIINWRLNWGHIPSHPRVTVTSEGGRGTLIIRDVKESDQGAYTCEAMNARGMVFGIPDGVLELVPQRGPCPDGHFYLEHSAACLPCFCFGITSVCQSTRRFRDQIRLRFDQPDDFKGVNVTMPAQPGTPPLSSTQLQIDPSLHEFQLVDLSRRFLVHDSFWALPEQFLGNKVDSYGGSLRYNVRYELARGMLEPVQRPDVVLMGAGYRLLSRGHTPTQPGALNQRQVQFSEEHWVHESGRPVQRAELLQVLQSLEAVLIQTVYNTKMASVGLSDIAMDTTVTHATSHGRAHSVEECRCPIGYSGLSCESCDAHFTRVPGGPYLGTCSGCNCNGHASSCDPVYGHCLNCQHNTEGPQCNKCKAGFFGDAMKATATSCRPCPCPYIDASRRFSDTCFLDTDGQATCDACAPGYTGRRCESCAPGYEGNPIQPGGKCRPVNQEIVRCDERGSMGTSGEACRCKNNVVGRLCNECADGSFHLSTRNPDGCLKCFCMGVSRHCTSSSWSRAQLHGASEEPGHFSLTNAASTHTTNEGIFSPTPGELGFSSFHRLLSGPYFWSLPSRFLGDKVTSYGGELRFTVTQRSQPGSTPLHGQPLVVLQGNNIILEHHVAQEPSPGQPSTFIVPFREQAWQRPDGQPATREHLLMALAGIDTLLIRASYAQQPAESRVSGISMDVAVPEETGQDPALEVEQCSCPPGYRGPSCQDCDTGYTRTPSGLYLGTCERCSCHGHSEACEPETGACQGCQHHTEGPRCEQCQPGYYGDAQRGTPQDCQLCPCYGDPAAGQAAHTCFLDTDGHPTCDACSPGHSGRHCERCAPGYYGNPSQGQPCQRDSQVPGPIGCNCDPQGSVSSQCDAAGQCQCKAQVEGLTCSHCRPHHFHLSASNPDGCLPCFCMGITQQCASSAYTRHLISTHFAPGDFQGFALVNPQRNSRLTGEFTVEPVPEGAQLSFGNFAQLGHESFYWQLPETYQGDKVAAYGGKLRYTLSYTAGPQGSPLSDPDVQITGNNIMLVASQPALQGPERRSYEIMFREEFWRRPDGQPATREHLLMALADLDELLIRATFSSVPLAASISAVSLEVAQPGPSNRPRALEVEECRCPPGYIGLSCQDCAPGYTRTGSGLYLGHCELCECNGHSDLCHPETGACSQCQHNAAGEFCELCAPGYYGDATAGTPEDCQPCACPLTNPENMFSRTCESLGAGGYRCTACEPGYTGQYCEQCGPGYVGNPSVQGGQCLPETNQAPLVVEVHPARSIVPQGGSHSLRCQVSGSPPHYFYWSREDGRPVPSGTQQRHQGSELHFPSVQPSDAGVYICTCRNLHQSNTSRAELLVTEAPSKPITVTVEEQRSQSVRPGADVTFICTAKSKSPAYTLVWTRLHNGKLPTRAMDFNGILTIRNVQLSDAGTYVCTGSNMFAMDQGTATLHVQASGTLSAPVVSIHPPQLTVQPGQLAEFRCSATGSPTPTLEWTGGPGGQLPAKAQIHGGILRLPAVEPTDQAQYLCRAHSSAGQQVARAVLHVHGGGGPRVQVSPERTQVHAGRTVRLYCRAAGVPSATITWRKEGGSLPPQARSERTDIATLLIPAITTADAGFYLCVATSPAGTAQARIQVVVLSASDASPPPVKIESSSPSVTEGQTLDLNCVVAGSAHAQVTWYRRGGSLPPHTQVHGSRLRLPQVSPADSGEYVCRVENGSGPKEASITVSVLHGTHSGPSYTPVPGSTRPIRIEPSSSHVAEGQTLDLNCVVPGQAHAQVTWHKRGGSLPARHQTHGSLLRLHQVTPADSGEYVCHVVGTSGPLEASVLVTIEASVIPGPIPPVRIESSSSTVAEGQTLDLSCVVAGQAHAQVTWYKRGGSLPARHQVRGSRLYIFQASPADAGQYVCRASNGMEASITVTVTGTQGANLAYPAGSTQPIRIEPSSSQVAEGQTLDLNCVVPGQSHAQVTWHKRGGSLPVRHQTHGSLLRLYQASPADSGEYVCRVLGSSVPLEASVLVTIEPAGSVPALGVTPTVRIESSSSQVAEGQTLDLNCLVAGQAHAQVTWHKRGGSLPARHQVHGSRLRLLQVTPADSGEYVCRVVGSSGTQEASVLVTIQQRLSGSHSQGVAYPVRIESSSASLANGHTLDLNCLVASQAPHTITWYKRGGSLPSRHQIVGSRLRIPQVTPADSGEYVCHVSNGAGSRETSLIVTIQGSGSSHVPSVSPPIRIESSSPTVVEGQTLDLNCVVARQPQAIITWYKRGGSLPSRHQTHGSHLRLHQMSVADSGEYVCRANNNIDALEASIVISVSPSAGSPSAPGSSMPIRIESSSSHVAEGETLDLNCVVPGQAHAQVTWHKRGGSLPSHHQTRGSRLRLHHVSPADSGEYVCRVMGSSGPLEASVLVTIEASGSSAVHVPAPGGAPPIRIEPSSSRVAEGQTLDLKCVVPGQAHAQVTWHKRGGNLPARHQVHGPLLRLNQVSPADSGEYSCQVTGSSGTLEASVLVTIEPSSPGPIPAPGLAQPIYIEASSSHVTEGQTLDLNCVVPGQAHAQVTWYKRGGSLPARHQTHGSQLRLHLVSPADSGEYVCRAASGPGPEQEASFTVTVPPSEGSSYRLRSPVISIDPPSSTVQQGQDASFKCLIHDGAAPISLEWKTRNQELEDNVHISPNGSIITIVGTRPSNHGTYRCVASNAYGVAQSVVNLSVHGPPTVSVLPEGPVWVKVGKAVTLECVSAGEPRSSARWTRISSTPAKLEQRTYGLMDSHAVLQISSAKPSDAGTYVCLAQNALGTAQKQVEVIVDTGAMAPGAPQVQAEEAELTVEAGHTATLRCSATGSPAPTIHWSKLRSPLPWQHRLEGDTLIIPRVAQQDSGQYICNATSPAGHAEATIILHVESPPYATTVPEHASVQAGETVQLQCLAHGTPPLTFQWSRVGSSLPGRATARNELLHFERAAPEDSGRYRCRVTNKVGSAEAFAQLLVQGPPGSLPATSIPAGSTPTVQVTPQLETKSIGASVEFHCAVPSDRGTQLRWFKEGGQLPPGHSVQDGVLRIQNLDQSCQGTYICQAHGPWGKAQASAQLVIQALPSVLINIRTSVQTVVVGHAVEFECLALGDPKPQVTWSKVGGHLRPGIVQSGGVVRIAHVELADAGQYRCTATNAAGTTQSHVLLLVQALPQISMPQEVRVPAGSAAVFPCIASGYPTPDISWSKLDGSLPPDSRLENNMLMLPSVRPQDAGTYVCTATNRQGKVKAFAHLQVPERVVPYFTQTPYSFLPLPTIKDAYRKFEIKITFRPDSADGMLLYNGQKRVPGSPTNLANRQPDFISFGLVGGRPEFRFDAGSGMATIRHPTPLALGHFHTVTLLRSLTQGSLIVGDLAPVNGTSQGKFQGLDLNEELYLGGYPDYGAIPKAGLSSGFIGCVRELRIQGEEIVFHDLNLTAHGISHCPTCRDRPCQNGGQCHDSESSSYVCVCPAGFTGSRCEHSQALHCHPEACGPDATCVNRPDGRGYTCRCHLGRSGLRCEEGVTVTTPSLSGAGSYLALPALTNTHHELRLDVEFKPLAPDGVLLFSGGKSGPVEDFVSLAMVGGHLEFRYELGSGLAVLRSAEPLALGRWHRVSAERLNKDGSLRVNGGRPVLRSSPGKSQGLNLHTLLYLGGVEPSVPLSPATNMSAHFRGCVGEVSVNGKRLDLTYSFLGSQGIGQCYDSSPCERQPCQHGATCMPAGEYEFQCLCRDGFKGDLCEHEENPCQLREPCLHGGTCQGTRCLCLPGFSGPRCQQGSGHGIAESDWHLEGSGGNDAPGQYGXYXHDDGFLAXPGHVXSRSLPEVPETXEXEXRTSTASGXXXWQGVEVGEAGQGKDXXSXGXQDGHXXFRXQXGSGEXRLVSEDPINDGEWHRXTXLREGRRGSXQVDGEELVSGRSPGPNVAVNAKGSXYXGGAPDVATLTGGRFSSGITGXXKNXVLHSARPGAPPPQPLDXQHRAQAGANTRPCPS

SEQ ID NO: 619 - protein, 4303 aa, Homo sapiens
  SITE (290)..(290): Xaa at position 290 is Ala, Gly, or Pro
  SITE (294)..(294): Xaa at position 294 is Ile, Ala, Val, Leu, or Gly
  SITE (305)..(305): Xaa at position 305 is Trp, Tyr, Phe, Met, His, Ile, Leu Val, Ala, or Gly
  SITE (307)..(307): Xaa at position 307 is Phe, Tyr, Met, His, Ile, Leu, Val Ala, or Gly
  SITE (323)..(323): Xaa at position 323 is His, Phe, Tyr, Lys, Arg, Gly, Ser Thr, Ala, Val, Leu, Ile, Asn, Met, or Gln
  SITE (325)..(325): Xaa at position 325 is Tyr, Phe, Met, His, Ile, Leu, Val Ala, or Gly
  SITE (333)..(333): Xaa at position 333 is Val, Ala, Gly, Leu, or Ile
  SITE (335)..(335): Xaa at position 335 is Ala, Gly, or Pro
  SITE (337)..(337): Xaa at position 337 is Leu, Ala, Val, Gly, or Ile
  SITE (352)..(352): Xaa at position 352 is Val, Ala, Gly, Leu, or Ile
MPPAAPARLALALGLGLWLGALAGGPGRGCGPCEPPCLCGPAPGAACRVNCSGRGLRTLGPALRIPADATALDVSHNLLRALDVGLLANLSALAELDISNNKISTLEEGIFANLFNLSEINLSGNPFECDCGLAWLPRWAEEQQVRVVQPEAATCAGPGSLAGQPLLGIPLLDSGCGEEYVACLPDNSSGTVAAVSFSAAHEGLLQPEACSAFCFSTGQGLAALSEQGWCLCGAAQPSSASFACLSLCSGPPPPPAPTCRGPTLLQHVFPASPGATLVGPHGPLASGQLXAFHXAAPLPVTATRXDXGDGSAEVDAAGPAASXRXVLPGRYHXTXVXALGAGSALLGTDVQXEAAPAALELVCPSSVQSDESLDLSIQNRGGSGLEAAYSIVALGEEPARAVHPLCPSDTEIFPGNGHCYRLVVEKAAWLQAQEQCQAWAGAALAMVDSPAVQRFLVSRVTRSLDVWIGFSTVQGVEVGPAPQGEAFSLESCQNWLPGEPHPATAEHCVRLGPTGWCNTDLCSAPHSYVCELQPGGPVQDAENLLVGAPSGDLQGPLTPLAQQDGLSAPHEPVEVMVFPGLRLSREAFLTTAEFGTQELRRPAQLRLQVYRLLSTAGTPENGSEPESRSPDNRTQLAPACMPGGRWCPGANICLPLDASCHPQACANGCTSGPGLPGAPYALWREFLFSVPAGPPAQYSVTLHGQDVLMLPGDLVGLQHDAGPGALLHCSPAPGHPGPRAPYLSANASSWLPHLPAQLEGTWACPACALRLLAATEQLTVLLGLRPNPGLRLPGRYEVRAEVGNGVSRHNLSCSFDVVSPVAGLRVIYPAPRDGRLYVPTNGSALVLQVDSGANATATARWPGGSVSARFENVCPALVATFVPGCPWETNDTLFSVVALPWLSEGEHVVDVVVENSASRANLSLRVTAEEPICGLRATPSPEARVLQGVLVRYSPVVEAGSDMVFRWTINDKQSLTFQNVVFNVIYQSAAVFKLSLTASNHVSNVTVNYNVTVERMNRMQGLQVSTVPAVLSPNATLALTAGVLVDSAVEVAFLWTFGDGEQALHQFQPPYNESFPVPDPSVAQVLVEHNVMHTYAAPGEYLLTVLASNAFENLTQQVPVSVRASLPSVAVGVSDGVLVAGRPVTFYPHPLPSPGGVLYTWDFGDGSPVLTQSQPAANHTYASRGTYHVRLEVNNTVSGAAAQADVRVFEELRGLSVDMSLAVEQGAPVVVSAAVQTGDNITWTFDMGDGTVLSGPEATVEHVYLRAQNCTVTVGAASPAGHLARSLHVLVFVLEVLRVEPAACIPTQPDARLTAYVTGNPAHYLFDWTFGDGSSNTTVRGCPTVTHNFTRSGTFPLALVLSSRVNRAHYFTSICVEPEVGNVTLQPERQFVQLGDEAWLVACAWPPFPYRYTWDFGTEEAAPTRARGPEVTFIYRDPGSYLVTVTASNNISAANDSALVEVQEPVLVTSIKVNGSLGLELQQPYLFSAVGRGRPASYLWDLGDGGWLEGPEVTHAYNSTGDFTVRVAGWNEVSRSEAWLNVTVKRRVRGLVVNASRTVVPLNGSVSFSTSLEAGSDVRYSWVLCDRCTPIPGGPTISYTFRSVGTFNIIVTAENEVGSAQDSIFVYVLQLIEGLQVVGGGRYFPTNHTVQLQAVVRDGTNVSYSWTAWRDRGPALAGSGKGFSLTVLEAGTYHVQLRATNMLGSAWADCTMDFVEPVGWLMVAASPNPAAVNTSVTLSAELAGGSGVVYTWSLEEGLSWETSEPFTTHSFPTPGLHLVTMTAGNPLGSANATVEVDVQVPVSGLSIRASEPGGSFVAAGSSVPFWGQLATGTNVSWCWAVPGGSSKRGPHVTMVFPDAGTFSIRLNASNAVSWVSATYNLTAEEPIVGLVLWASSKVVAPGQLVHFQILLAAGSAVTFRLQVGGANPEVLPGPRFSHSFPRVGDHVVSVRGKNHVSWAQAQVRIVVLEAVSGLQVPNCCEPGIATGTERNFTARVQRGSRVAYAWYFSLQKVQGDSLVILSGRDVTYTPVAAGLLEIQVRAFNALGSENRTLVLEVQDAVQYVALQSGPCFTNRSAQFEAATSPSPRRVAYHWDFGDGSPGQDTDEPRAEHSYLRPGDYRVQVNASNLVSFFVAQATVTVQVLACREPEVDVVLPLQVLMRRSQRNYLEAHVDLRDCVTYQTEYRWEVYRTASCQRPGRPARVALPGVDVSRPRLVLPRLALPVGHYCFVFVVSFGDTPLTQSIQANVTVAPERLVPIIEGGSYRVWSDTRDLVLDGSESYDPNLEDGDQTPLSFHWACVASTQREAGGCALNFGPRGSSTVTIPRERLAAGVEYTFSLTVWKAGRKEEATNQTVLIRSGRVPIVSLECVSCKAQAVYEVSRSSYVYLEGRCLNCSSGSKRGRWAARTFSNKTLVLDETTTSTGSAGMRLVLRRGVLRDGEGYTFTLTVLGRSGEEEGCASIRLSPNRPPLGGSCRLFPLGAVHALTTKVHFECTGWHDAEDAGAPLVYALLLRRCRQGHCEEFCVYKGSLSSYGAVLPPGFRPHFEVGLAVVVQDQLGAAVVALNRSLAITLPEPNGSATGLTVWLHGLTASVLPGLLRQADPQHVIEYSLALVTVLNEYERALDVAAEPKHERQHRAQIRKNITETLVSLRVHTVDDIQQIAAALAQCMGPSRELVCRSCLKQTLHKLEAMMLILQAETTAGTVTPTAIGDSILNITGDLIHLASSDVRAPQPSELGAESPSRMVASQAYNLTSALMRILMRSRVLNEEPLTLAGEEIVAQGKRSDPRSLLCYGGAPGPGCHFSIPEAFSGALANLSDVVQLIFLVDSNPFPFGYISNYTVSTKVASMAFQTQAGAQIPIERLASERAITVKVPNNSDWAARGHRSSANSANSVVVQPQASVGAVVTLDSSNPAAGLHLQLNYTLLDGHYLSEEPEPYLAVYLHSEPRPNEHNCSASRRIRPESLQGADHRPYTFFISPGSRDPAGSYHLNLSSHFRWSALQVSVGLYTSLCQYFSEEDMVWRTEGLLPLEETSPRQAVCLTRHLTAFGASLFVPPSHVRFVFPEPTADVNYIVMLTCAVCLVTYMVMAAILHKLDQLDASRGRAIPFCGQRGRFKYEILVKTGWGRGSGTTAHVGIMLYGVDSRSGHRHLDGDRAFHRNSLDIFRIATPHSLGSVWKIRVWHDNKGLSPAWFLQHVIVRDLQTARSAFFLVNDWLSVETEANGGLVEKEVLAASDAALLRFRRLLVAELQRGFFDKHIWLSIWDRPPRSRFTRIQRATCCVLLICLFLGANAVWYGAVGDSAYSTGHVSRLSPLSVDTVAVGLVSSVVVYPVYLAILFLFRMSRSKVAGSPSPTPAGQQVLDIDSCLDSSVLDSSFLTFSGLHAEQAFVGQMKSDLFLDDSKSLVCWPSGEGTLSWPDLLSDPSIVGSNLRQLARGQAGHGLGPEEDGFSLASPYSPAKSFSASDEDLIQQVLAEGVSSPAPTQDTHMETDLLSSLSSTPGEKTETLALQRLGELGPPSPGLNWEQPQAARLSRTGLVEGLRKRLLPAWCASLAHGLSLLLVAVAVAVSGWVGASFPPGVSVAWLLSSSASFLASFLGWEPLKVLLEALYFSLVAKRLHPDEDDTLVESPAVTPVSARVPRVRPPHGFALFLAKEEARKVKRLHGMLRSLLVYMLFLLVTLLASYGDASCHGHAYRLQSAIKQELHSRAFLAITRSEELWPWMAHVLLPYVHGNQSSPELGPPRLRQVRLQEALYPDPPGPRVHTCSAAGGFSTSDYDVGWESPHNGSGTWAYSAPDLLGAWSWGSCAVYDSGGYVQELGLSLEESRDRLRFLQLHNWLDNRSRAVFLELTRYSPAVGLHAAVTLRLEFPAAGRALAALSVRPFALRRLSAGLSLPLLTSVCLLLFAVHFAVAEARTWHREGRWRVLRLGAWARWLLVALTAATALVRLAQLGAADRQWTRFVRGRPRRFTSFDQVAQLSSAARGLAASLLFLLLVKAAQQLRFVRQWSVFGKTLCRALPELLGVTLGLVVLGVAYAQLAILLVSSCVDSLWSVAQALLVLCPGTGLSTLCPAESWHLSPLLCVGLWALRLWGALRLGAVILRWRYHALRGELYRPAWEPQDYEMVELFLRRLRLWMGLSKVKEFRHKVRFEGMEPLPSRSSRGSKVSPDVPPPSAGSDASHPSTSSSQLDGLSVSLGRLGTRCEPEPSRLQAVFEALLTQFDRLNQATEDVYQLEQQLHSLQGRRSSRAPAGSSRGPSPGLRPALPSRLARASRGVDLATGPSRTPLRAKNKVHPSST

SEQ ID NO: 620 - protein, 900 aa, Homo sapiens
  SITE (65)..(65): Xaa at position 65 is Leu, Ala, Val, Gly, or Ile
  SITE (80)..(80): Xaa at position 80 is Val, Ala, Gly, Leu, or Ile
  SITE (89)..(89): Xaa at position 89 is Ala, Gly, or Pro
  SITE (91)..(91): Xaa at position 91 is Ile, Ala, Val, Leu, or Gly
  SITE (93)..(93): Xaa at position 93 is Val, Ala, Gly, Leu, or Ile
  SITE (96)..(96): Xaa at position 96 is Val, Ala, Gly, Leu, or Ile
  SITE (105)..(105): Xaa at position 105 is His, Phe, Tyr, Lys, Arg, Gly, Ser Thr, Ala, Val, Leu, Ile, Asn, Met, or Gln
  SITE (106)..(106): Xaa at position 106 is Ala, Gly, or Pro
  SITE (107)..(107): Xaa at position 107 is His, Phe, Tyr, Lys, Arg, Gly, Ser Thr, Ala, Val, Leu, Ile, Asn, Met, or Gln
  SITE (119)..(119): Xaa at position 119 is Ile, Ala, Val, Leu, or Gly
  SITE (120)..(120): Xaa at position 120 is Cys, Ala, Val, Gly, Ser, or Thr
  SITE (131)..(131): Xaa at position 131 is Ala, Gly, or Pro
  SITE (136)..(136): Xaa at position 136 is Leu, Ala, Val, Gly, or Ile
  SITE (150)..(150): Xaa at position 150 is Met, Ile, Leu, Val, Ala, or Gly
  SITE (174)..(174): Xaa at position 174 is Leu, Ala, Val, Gly, or Ile
  SITE (178)..(178): Xaa at position 178 is Ala, Gly, or Pro
  SITE (190)..(190): Xaa at position 190 is Val, Ala, Gly, Leu, or Ile
  SITE (192)..(192): Xaa at position 192 is Leu, Ala, Val, Gly, or Ile
  SITE (194)..(194): Xaa at position 194 is Phe, Tyr, Met, His, Ile, Leu, Val Ala, or Gly
  SITE (196)..(196): Xaa at position 196 is Ala, Gly, or Pro
  SITE (217)..(217): Xaa at position 217 is Ile, Ala, Val, Leu, or Gly
  SITE (228)..(228): Xaa at position 228 is Leu, Ala, Val, Gly, or Ile
  SITE (246)..(246): Xaa at position 246 is Val, Ala, Gly, Leu, or Ile
  SITE (248)..(248): Xaa at position 248 is Leu, Ala, Val, Gly, or Ile
  SITE (249)..(249): Xaa at position 249 is Leu, Ala, Val, Gly, or Ile
  SITE (260)..(260): Xaa at position 260 is Val, Ala, Gly, Leu, or Ile
  SITE (262)..(262): Xaa at position 262 is Phe, Tyr, Met, His, Ile, Leu, Val Ala, or Gly
  SITE (287)..(287): Xaa at position 287 is Ile, Ala, Val, Leu, or Gly
  SITE (288)..(288): Xaa at position 288 is Val, Ala, Gly, Leu, or Ile
  SITE (289)..(289): Xaa at position 289 is Phe, Tyr, Met, His, Ile, Leu, Val Ala, or Gly
  SITE (305)..(305): Xaa at position 305 is Val, Ala, Gly, Leu, or Ile
  SITE (307)..(307): Xaa at position 307 is Leu, Ala, Val, Gly, or Ile
  SITE (309)..(309): Xaa at position 309 is Leu, Ala, Val, Gly, or Ile
  SITE (323)..(323): Xaa at position 323 is Phe, Tyr, Met, His, Ile, Leu, Val Ala, or Gly
  SITE (325)..(325): Xaa at position 325 is Tyr, Phe, Met, His, Ile, Leu, Val Ala, or Gly
  SITE (326)..(326): Xaa at position 326 is Tyr, Phe, Met, His, Ile, Leu, Val Ala, or Gly
  SITE (493)..(493): Xaa at position 493 is His, Phe, Tyr, Lys, Arg, Gly, Ser Thr, Ala, Val, Leu, Ile, Asn, Met, or Gln
  SITE (496)..(496): Xaa at position 496 is Ile, Ala, Val, Leu, or Gly
  SITE (504)..(504): Xaa at position 504 is Ile, Ala, Val, Leu, or Gly
  SITE (511)..(511): Xaa at position 511 is Ile, Ala, Val, Leu, or Gly
  SITE (520)..(520): Xaa at position 520 is Val, Ala, Gly, Leu, or Ile
  SITE (531)..(531): Xaa at position 531 is Leu, Ala, Val, Gly, or Ile
  SITE (532)..(532): Xaa at position 532 is His, Phe, Tyr, Lys, Arg, Gly, Ser Thr, Ala, Val, Leu, Ile, Asn, Met, or Gln
  SITE (534)..(534): Xaa at position 534 is Ala, Gly, or Pro
  SITE (543)..(543): Xaa at position 543 is Val, Ala, Gly, Leu, or Ile
  SITE (546)..(546): Xaa at position 546 is Leu, Ala, Val, Gly, or Ile
  SITE (551)..(551): Xaa at position 551 is Ala, Gly, or Pro
  SITE (563)..(563): Xaa at position 563 is Ala, Gly, or Pro
  SITE (564)..(564): Xaa at position 564 is Met, Ile, Leu, Val, Ala, or Gly
  SITE (565)..(565): Xaa at position 565 is His, Phe, Tyr, Lys, Arg, Gly, Ser Thr, Ala, Val, Leu, Ile, Asn, Met, or Gln
  SITE (567)..(567): Xaa at position 567 is Ala, Gly, or Pro
  SITE (578)..(578): Xaa at position 578 is Leu, Ala, Val, Gly, or Ile
  SITE (605)..(605): Xaa at position 605 is His, Phe, Tyr, Lys, Arg, Gly, Ser Thr, Ala, Val, Leu, Ile, Asn, Met, or Gln
  SITE (607)..(607): Xaa at position 607 is Ala, Gly, or Pro
  SITE (608)..(608): Xaa at position 608 is Val, Ala, Gly, Leu, or Ile
  SITE (619)..(619): Xaa at position 619 is Leu, Ala, Val, Gly, or Ile
  SITE (637)..(637): Xaa at position 637 is Ala, Gly, or Pro
  SITE (639)..(639): Xaa at position 639 is His, Phe, Tyr, Lys, Arg, Gly, Ser Thr, Ala, Val, Leu, Ile, Asn, Met, or Gln
  SITE (641)..(641): Xaa at position 641 is Ala, Gly, or Pro
  SITE (650)..(650): Xaa at position 650 is Val, Ala, Gly, Leu, or Ile
  SITE (653)..(653): Xaa at position 653 is Leu, Ala, Val, Gly, or Ile
  SITE (675)..(675): Xaa at position 675 is Ala, Gly, or Pro
  SITE (687)..(687): Xaa at position 687 is Leu, Ala, Val, Gly, or Ile
  SITE (742)..(742): Xaa at position 742 is Val, Ala, Gly, Leu, or Ile
  SITE (778)..(778): Xaa at position 778 is Leu, Ala, Val, Gly, or Ile
  SITE (782)..(782): Xaa at position 782 is Leu, Ala, Val, Gly, or Ile
  SITE (794)..(794): Xaa at position 794 is Leu, Ala, Val, Gly, or Ile
  SITE (795)..(795): Xaa at position 795 is Ala, Gly, or Pro
  SITE (817)..(817): Xaa at position 817 is Leu, Ala, Val, Gly, or Ile
  SITE (818)..(818): Xaa at position 818 is Leu, Ala, Val, Gly, or Ile
  SITE (831)..(831): Xaa at position 831 is Leu, Ala, Val, Gly, or Ile
  SITE (834)..(834): Xaa at position 834 is Ala, Gly, or Pro
  SITE (835)..(835): Xaa at position 835 is Leu, Ala, Val, Gly, or Ile
MESCYNPGLDGIIEYDDFKLNSSIVEPKEPAPETADGPYLVIVEQPKQRGFRFRYGCEGPSHGGXPGASSEKGRKTYPTXKICNYEGPXKXEXDLXTHSDPPRAXXXSLVGKQCSELGXXAVSVGPKDMTXQFNNXGVLHVTKKNMMGTXIQKLQRQRLRSRPQGLTEAEQREXEQEXKELKKVMDLSIXRXRXSXFLRASDGSFSLPLKPVISQPXHDSKSPGASNXKISRMDKTAGSVRGGDEXYXXCDKVQKDDIEXRXYEDDENGWQAFGDFSPTDVHKQYAXXXRTPPYHKMKIERPVTXFXQXKRKRGGDVSDSKQXTXXPLVEDKEEVQRKRRKALPTFSQPFGGGSHMGGGSGGAAGGYGGAGGGGSLGFFPSSLAYSPYQSGAGPMGCYPGGGGGAQMAATVPSRDSGEEAAEPSAPSRTPQCEPQAPEMLQRAREYNARLFGLAQRSARALLDYGVTADARALLAGQRHLLTAQDENGDTPLXLAXIHGQTSVXEQIVYVXHHAQDLGVXNLTNHLHQTPXXLXVITGQTSVXSFXLRVGXDPALLDRHGDSXXXLXLRAGAGAPELXRALLQSGAPAVPQLLHMPDFEGLYPVXLXXRARSPECLDLXVDSGAEVEATERQGGRTXLXLXTEMEELGLXTHXVTKLRANVNARTFAGNTPLHLXAGLGYPTLTRLXLKAGADIHAENEEPLCPLPSPPTSDSDSDSEGPEKDTRSSFRGHTPLDLTCSTKXKTLLLNAAQNTMEPPLTPPSPAGPGLSLGDTALQNXEQLXDGPEAQGSWAEXXERLGLRSLVDTYRQTTSPSGSXXRSYELAGGDLAGXLEXXSDMGLEEGVRLLRGPETRDKLPSTAEVKEDSAYGSQSVEQEAEKLGPPPEPPGGLCHGHPQPQVH

SEQ ID NO: 621 - protein, 533 aa, Homo sapiens
  SITE (281)..(281): Xaa at position 281 is Ile, Ala, Val, Leu, or Gly
  SITE (299)..(299): Xaa at position 299 is Ile, Ala, Val, Leu, or Gly
  SITE (308)..(308): Xaa at position 308 is Val, Ala, Gly, Leu, or Ile
  SITE (309)..(309): Xaa at position 309 is Val, Ala, Gly, Leu, or Ile
  SITE (310)..(310): Xaa at position 310 is Ile, Ala, Val, Leu, or Gly
  SITE (311)..(311): Xaa at position 311 is Ala, Gly, or Pro
  SITE (325)..(325): Xaa at position 325 is Val, Ala, Gly, Leu, or Ile
  SITE (330)..(330): Xaa at position 330 is Met, Ile, Leu, Val, Ala, or Gly
  SITE (342)..(342): Xaa at position 342 is Leu, Ala, Val, Gly, or Ile
  SITE (343)..(343): Xaa at position 343 is Ala, Gly, or Pro
  SITE (347)..(347): Xaa at position 347 is Val, Ala, Gly, Leu, or Ile
  SITE (351)..(351): Xaa at position 351 is Tyr, Phe, Met, His, Ile, Leu, Val Ala, or Gly
  SITE (361)..(361): Xaa at position 361 is Phe, Tyr, Met, His, Ile, Leu, Val Ala, or Gly
  SITE (382)..(382): Xaa at position 382 is Val, Ala, Gly, Leu, or Ile
  SITE (426)..(426): Xaa at position 426 is Phe, Tyr, Met, His, Ile, Leu, Val Ala, or Gly
  SITE (429)..(429): Xaa at position 429 is Cys, Ala, Val, Gly, Ser, or Thr
  SITE (449)..(449): Xaa at position 449 is Val, Ala, Gly, Leu, or Ile
MWLGRRALCALVLLLACASLGLLYASTRDAPGLRLPLAPWAPPQSPRRPELPDLAPEPRYAHIPVRIKEQVVGLLAWNNCSCESSGGGLPLPFQKQVRAIDLTKAFDPAELRAASATREQEFQAFLSRSQSPADQLLIAPANSPLQYPLQGVEVQPLRSILVPGLSLQAASGQEVYQVNLTASLGTWDVAGEVTGVTLTGEGQADLTLVSPGLDQLNRQLQLVTYSSRSYQTNTADTVRFSTEGHEAAFTIRIRHPPNPRLYPPGSLPQGAQYNISALVTXATKTFLRYDRLRALITSXRRFYPTVTXXXXDDSDKPERVSGPYXEHYLXPFGKGWFAGRNXXVSQXTTKXVLWVDDDFVXTARTRLERLVDVLERTPLDLXGGAVREISGFATTYRQLLSVEPGAPGLGNCLRQRRGFHHELVGXPGXVVTDGVVNFFLARTDKVREXGFDPRLSRVAHLEFFLDGLGSLRVGSCSDVVVDHASKLKLPWTSRDAGAETYARYRYPGSLDESQMAKHRLLFFKHRLQCMTSQ

SEQ ID NO: 622 - protein, 3957 aa, Homo sapiens
  SITE (35)..(35): Xaa at position 35 is Phe, Tyr, Met, His, Ile, Leu, Val Ala, or Gly
  SITE (39)..(39): Xaa at position 39 is Ala, Gly, or Pro
  SITE (47)..(47): Xaa at position 47 is Val, Ala, Gly, Leu, or Ile
  SITE (65)..(65): Xaa at position 65 is Leu, Ala, Val, Gly, or Ile
  SITE (67)..(67): Xaa at position 67 is Ala, Gly, or Pro
  SITE (69)..(69): Xaa at position 69 is His, Phe, Tyr, Lys, Arg, Gly, Ser Thr, Ala, Val, Leu, Ile, Asn, Met, or Gln
  SITE (70)..(70): Xaa at position 70 is Leu, Ala, Val, Gly, or Ile
  SITE (71)..(71): Xaa at position 71 is Ala, Gly, or Pro
  SITE (72)..(72): Xaa at position 72 is Ala, Gly, or Pro
  SITE (80)..(80): Xaa at position 80 is Val, Ala, Gly, Leu, or Ile
  SITE (83)..(83): Xaa at position 83 is Leu, Ala, Val, Gly, or Ile
  SITE (100)..(100): Xaa at position 100 is Ala, Gly, or Pro
  SITE (101)..(101): Xaa at position 101 is Leu, Ala, Val, Gly, or Ile
  SITE (102)..(102): Xaa at position 102 is His, Phe, Tyr, Lys, Arg, Gly, Ser Thr, Ala, Val, Leu, Ile, Asn, Met, or Gln
  SITE (104)..(104): Xaa at position 104 is Ala, Gly, or Pro
  SITE (112)..(112): Xaa at position 112 is Val, Ala, Gly, Leu, or Ile
  SITE (113)..(113): Xaa at position 113 is Val, Ala, Gly, Leu, or Ile
  SITE (116)..(116): Xaa at position 116 is Leu, Ala, Val, Gly, or Ile
  SITE (134)..(134): Xaa at position 134 is Leu, Ala, Val, Gly, or Ile
  SITE (135)..(135): Xaa at position 135 is Tyr, Phe, Met, His, Ile, Leu, Val Ala, or Gly
  SITE (137)..(137): Xaa at position 137 is Ala, Gly, or Pro
  SITE (138)..(138): Xaa at position 138 is Ala, Gly, or Pro
  SITE (145)..(145): Xaa at position 145 is Val, Ala, Gly, Leu, or Ile
  SITE (146)..(146): Xaa at position 146 is Val, Ala, Gly, Leu, or Ile
  SITE (149)..(149): Xaa at position 149 is Leu, Ala, Val, Gly, or Ile
  SITE (168)..(168): Xaa at position 168 is Ala, Gly, or Pro
  SITE (169)..(169): Xaa at position 169 is Val, Ala, Gly, Leu, or Ile
  SITE (170)..(170): Xaa at position 170 is Ala, Gly, or Pro
  SITE (178)..(178): Xaa at position 178 is Ala, Gly, or Pro
  SITE (182)..(182): Xaa at position 182 is Leu, Ala, Val, Gly, or Ile
  SITE (197)..(197): Xaa at position 197 is His, Phe, Tyr, Lys, Arg, Gly, Ser Thr, Ala, Val, Leu, Ile, Asn, Met, or Gln
  SITE (199)..(199): Xaa at position 199 is Ala, Gly, or Pro
  SITE (200)..(200): Xaa at position 200 is Ala, Gly, or Pro
  SITE (208)..(208): Xaa at position 208 is Ala, Gly, or Pro
  SITE (212)..(212): Xaa at position 212 is Leu, Ala, Val, Gly, or Ile
  SITE (226)..(226): Xaa at position 226 is Val, Ala, Gly, Leu, or Ile
  SITE (237)..(237): Xaa at position 237 is Leu, Ala, Val, Gly, or Ile
  SITE (238)..(238): Xaa at position 238 is His, Phe, Tyr, Lys, Arg, Gly, Ser Thr, Ala, Val, Leu, Ile, Asn, Met, or Gln
  SITE (240)..(240): Xaa at position 240 is Ala, Gly, or Pro
  SITE (241)..(241): Xaa at position 241 is Ala, Gly, or Pro
  SITE (248)..(248): Xaa at position 248 is Val, Ala, Gly, Leu, or Ile
  SITE (249)..(249): Xaa at position 249 is Ala, Gly, or Pro
  SITE (252)..(252): Xaa at position 252 is Leu, Ala, Val, Gly, or Ile
  SITE (270)..(270): Xaa at position 270 is Leu, Ala, Val, Gly, or Ile
  SITE (271)..(271): Xaa at position 271 is His, Phe, Tyr, Lys, Arg, Gly, Ser Thr, Ala, Val, Leu, Ile, Asn, Met, or Gln
  SITE (272)..(272): Xaa at position 272 is Val, Ala, Gly, Leu, or Ile
  SITE (273)..(273): Xaa at position 273 is Ala, Gly, or Pro
  SITE (281)..(281): Xaa at position 281 is Met, Ile, Leu, Val, Ala, or Gly
  SITE (282)..(282): Xaa at position 282 is Val, Ala, Gly, Leu, or Ile
  SITE (285)..(285): Xaa at position 285 is Leu, Ala, Val, Gly, or Ile
  SITE (303)..(303): Xaa at position 303 is Leu, Ala, Val, Gly, or Ile
  SITE (304)..(304): Xaa at position 304 is His, Phe, Tyr, Lys, Arg, Gly, Ser Thr, Ala, Val, Leu, Ile, Asn, Met, or Gln
  SITE (305)..(305): Xaa at position 305 is Cys, Ala, Val, Gly, Ser, or Thr
  SITE (306)..(306): Xaa at position 306 is Ala, Gly, or Pro
  SITE (307)..(307): Xaa at position 307 is Ala, Gly, or Pro
  SITE (314)..(314): Xaa at position 314 is Val, Ala, Gly, Leu, or Ile
  SITE (315)..(315): Xaa at position 315 is Val, Ala, Gly, Leu, or Ile
  SITE (318)..(318): Xaa at position 318 is Leu, Ala, Val, Gly, or Ile
  SITE (336)..(336): Xaa at position 336 is Leu, Ala, Val, Gly, or Ile
  SITE (337)..(337): Xaa at position 337 is His, Phe, Tyr, Lys, Arg, Gly, Ser Thr, Ala, Val, Leu, Ile, Asn, Met, or Gln
  SITE (338)..(338): Xaa at position 338 is Met, Ile, Leu, Val, Ala, or Gly
  SITE (339)..(339): Xaa at position 339 is Ala, Gly, or Pro
  SITE (340)..(340): Xaa at position 340 is Ala, Gly, or Pro
  SITE (347)..(347): Xaa at position 347 is Cys, Ala, Val, Gly, Ser, or Thr
  SITE (348)..(348): Xaa at position 348 is Val, Ala, Gly, Leu, or Ile
  SITE (351)..(351): Xaa at position 351 is Leu, Ala, Val, Gly, or Ile
  SITE (371)..(371): Xaa at position 371 is Val, Ala, Gly, Leu, or Ile
  SITE (372)..(372): Xaa at position 372 is Ala, Gly, or Pro
  SITE (380)..(380): Xaa at position 380 is Val, Ala, Gly, Leu, or Ile
  SITE (384)..(384): Xaa at position 384 is Leu, Ala, Val, Gly, or Ile
  SITE (468)..(468): Xaa at position 468 is Leu, Ala, Val, Gly, or Ile
  SITE (469)..(469): Xaa at position 469 is His, Phe, Tyr, Lys, Arg, Gly, Ser Thr, Ala, Val, Leu, Ile, Asn, Met, or Gln
  SITE (471)..(471): Xaa at position 471 is Ala, Gly, or Pro
  SITE (472)..(472): Xaa at position 472 is Ala, Gly, or Pro
  SITE (480)..(480): Xaa at position 480 is Val, Ala, Gly, Leu, or Ile
  SITE (501)..(501): Xaa at position 501 is Leu, Ala, Val, Gly, or Ile
  SITE (502)..(502): Xaa at position 502 is His, Phe, Tyr, Lys, Arg, Gly, Ser Thr, Ala, Val, Leu, Ile, Asn, Met, or Gln
  SITE (503)..(503): Xaa at position 503 is Ile, Ala, Val, Leu, or Gly
  SITE (504)..(504): Xaa at position 504 is Ala, Gly, or Pro
  SITE (513)..(513): Xaa at position 513 is Val, Ala, Gly, Leu, or Ile
  SITE (516)..(516): Xaa at position 516 is Leu, Ala, Val, Gly, or Ile
  SITE (534)..(534): Xaa at position 534 is Leu, Ala, Val, Gly, or Ile
  SITE (535)..(535): Xaa at position 535 is His, Phe, Tyr, Lys, Arg, Gly, Ser Thr, Ala, Val, Leu, Ile, Asn, Met, or Gln
  SITE (536)..(536): Xaa at position 536 is Ile, Ala, Val, Leu, or Gly
  SITE (538)..(538): Xaa at position 538 is Ala, Gly, or Pro
  SITE (545)..(545): Xaa at position 545 is Val, Ala, Gly, Leu, or Ile
  SITE (546)..(546): Xaa at position 546 is Ala, Gly, or Pro
  SITE (549)..(549): Xaa at position 549 is Leu, Ala, Val, Gly, or Ile
  SITE (567)..(567): Xaa at position 567 is Leu, Ala, Val, Gly, or Ile
  SITE (568)..(568): Xaa at position 568 is His, Phe, Tyr, Lys, Arg, Gly, Ser Thr, Ala, Val, Leu, Ile, Asn, Met, or Gln
  SITE (569)..(569): Xaa at position 569 is Val, Ala, Gly, Leu, or Ile
  SITE (570)..(570): Xaa at position 570 is Ala, Gly, or Pro
  SITE (571)..(571): Xaa at position 571 is Ala, Gly, or Pro
  SITE (579)..(579): Xaa at position 579 is Ala, Gly, or Pro
  SITE (582)..(582): Xaa at position 582 is Leu, Ala, Val, Gly, or Ile
  SITE (602)..(602): Xaa at position 602 is Val, Ala, Gly, Leu, or Ile
  SITE (603)..(603): Xaa at position 603 is Ala, Gly, or Pro
  SITE (611)..(611): Xaa at position 611 is Val, Ala, Gly, Leu, or Ile
  SITE (615)..(615): Xaa at position 615 is Leu, Ala, Val, Gly, or Ile
  SITE (839)..(839): Xaa at position 839 is Met, Ile, Leu, Val, Ala, or Gly
  SITE (970)..(970): Xaa at position 970 is Val, Ala, Gly, Leu, or Ile
  SITE (974)..(974): Xaa at position 974 is Val, Ala, Gly, Leu, or Ile
  SITE (991)..(991): Xaa at position 991 is Ile, Ala, Val, Leu, or Gly
  SITE (993)..(993): Xaa at position 993 is Ile, Ala, Val, Leu, or Gly
  SITE (1004)..(1004): Xaa at position 1004 is Val, Ala, Gly, Leu, or Ile
  SITE (1006)..(1006): Xaa at position 1006 is Cys, Ala, Val, Gly, Ser, or Thr
  SITE (1009)..(1009): Xaa at position 1009 is Val, Ala, Gly, Leu, or Ile
  SITE (1027)..(1027): Xaa at position 1027 is Ala, Gly, or Pro
  SITE (1031)..(1031): Xaa at position 1031 is Ile, Ala, Val, Leu, or Gly
  SITE (1033)..(1033): Xaa at position 1033 is Val, Ala, Gly, Leu, or Ile
  SITE (1077)..(1077): Xaa at position 1077 is Val, Ala, Gly, Leu, or Ile
  SITE (1079)..(1079): Xaa at position 1079 is Val, Ala, Gly, Leu, or Ile
  SITE (1081)..(1081): Xaa at position 1081 is Ile, Ala, Val, Leu, or Gly
  SITE (1085)..(1085): Xaa at position 1085 is Ala, Gly, or Pro
  SITE (1147)..(1147): Xaa at position 1147 is Phe, Tyr, Met, His, Ile, Leu Val, Ala, or Gly
  SITE (1151)..(1151): Xaa at position 1151 is Phe, Tyr, Met, His, Ile, Leu Val, Ala, or Gly
  SITE (1152)..(1152): Xaa at position 1152 is Ala, Gly, or Pro
  SITE (1153)..(1153): Xaa at position 1153 is Val, Ala, Gly, Leu, or Ile
  SITE (1154)..(1154): Xaa at position 1154 is Val, Ala, Gly, Leu, or Ile
  SITE (1164)..(1164): Xaa at position 1164 is Ile, Ala, Val, Leu, or Gly
  SITE (1179)..(1179): Xaa at position 1179 is Val, Ala, Gly, Leu, or Ile
  SITE (1181)..(1181): Xaa at position 1181 is Ala, Gly, or Pro
  SITE (1187)..(1187): Xaa at position 1187 is Ala, Gly, or Pro
  SITE (1194)..(1194): Xaa at position 1194 is Val, Ala, Gly, Leu, or Ile
  SITE (1196)..(1196): Xaa at position 1196 is Leu, Ala, Val, Gly, or Ile
  SITE (1220)..(1220): Xaa at position 1220 is Val, Ala, Gly, Leu, or Ile
  SITE (1222)..(1222): Xaa at position 1222 is Leu, Ala, Val, Gly, or Ile
  SITE (1233)..(1233): Xaa at position 1233 is Ile, Ala, Val, Leu, or Gly
  SITE (1235)..(1235): Xaa at position 1235 is Met, Ile, Leu, Val, Ala, or Gly
  SITE (1237)..(1237): Xaa at position 1237 is Ile, Ala, Val, Leu, or Gly
  SITE (1260)..(1260): Xaa at position 1260 is Leu, Ala, Val, Gly, or Ile
  SITE (1261)..(1261): Xaa at position 1261 is Leu, Ala, Val, Gly, or Ile
  SITE (1289)..(1289): Xaa at position 1289 is Val, Ala, Gly, Leu, or Ile
  SITE (1297)..(1297): Xaa at position 1297 is Ala, Gly, or Pro
  SITE (1300)..(1300): Xaa at position 1300 is Trp, Tyr, Phe, Met, His, Ile Leu, Val, Ala, or Gly
  SITE (1301)..(1301): Xaa at position 1301 is Leu, Ala, Val, Gly, or Ile
  SITE (1302)..(1302): Xaa at position 1302 is Ile, Ala, Val, Leu, or Gly
  SITE (1304)..(1304): Xaa at position 1304 is Cys, Ala, Val, Gly, Ser, or Thr
  SITE (1314)..(1314): Xaa at position 1314 is Ala, Gly, or Pro
  SITE (1317)..(1317): Xaa at position 1317 is Val, Ala, Gly, Leu, or Ile
  SITE (1328)..(1328): Xaa at position 1328 is Ala, Gly, or Pro
  SITE (1330)..(1330): Xaa at position 1330 is Phe, Tyr, Met, His, Ile, Leu Val, Ala, or Gly
  SITE (1332)..(1332): Xaa at position 1332 is Val, Ala, Gly, Leu, or Ile
  SITE (1334)..(1334): Xaa at position 1334 is Ala, Gly, or Pro
  SITE (1342)..(1342): Xaa at position 1342 is Ala, Gly, or Pro
  SITE (1344)..(1344): Xaa at position 1344 is Leu, Ala, Val, Gly, or Ile
  SITE (1346)..(1346): Xaa at position 1346 is Cys, Ala, Val, Gly, Ser, or Thr
  SITE (1347)..(1347): Xaa at position 1347 is Phe, Tyr, Met, His, Ile, Leu Val, Ala, or Gly
  SITE (1348)..(1348): Xaa at position 1348 is Cys, Ala, Val, Gly, Ser, or Thr
  SITE (1389)..(1389): Xaa at position 1389 is Leu, Ala, Val, Gly, or Ile
  SITE (1403)..(1403): Xaa at position 1403 is Phe, Tyr, Met, His, Ile, Leu Val, Ala, or Gly
  SITE (1413)..(1413): Xaa at position 1413 is Leu, Ala, Val, Gly, or Ile
  SITE (1415)..(1415): Xaa at position 1415 is Val, Ala, Gly, Leu, or Ile
  SITE (1428)..(1428): Xaa at position 1428 is Leu, Ala, Val, Gly, or Ile
  SITE (1430)..(1430): Xaa at position 1430 is Phe, Tyr, Met, His, Ile, Leu Val, Ala, or Gly
  SITE (1503)..(1503): Xaa at position 1503 is Leu, Ala, Val, Gly, or Ile
  SITE (3573)..(3573): Xaa at position 3573 is Leu, Ala, Val, Gly, or Ile
  SITE (3576)..(3576): Xaa at position 3576 is Ile, Ala, Val, Leu, or Gly
  SITE (3577)..(3577): Xaa at position 3577 is Ala, Gly, or Pro
  SITE (3587)..(3587): Xaa at position 3587 is Leu, Ala, Val, Gly, or Ile
  SITE (3588)..(3588): Xaa at position 3588 is Ala, Gly, or Pro
  SITE (3601)..(3601): Xaa at position 3601 is Ile, Ala, Val, Leu, or Gly
  SITE (3616)..(3616): Xaa at position 3616 is Leu, Ala, Val, Gly, or Ile
  SITE (3617)..(3617): Xaa at position 3617 is Leu, Ala, Val, Gly, or Ile
  SITE (3620)..(3620): Xaa at position 3620 is Trp, Tyr, Phe, Met, His, Ile Leu, Val, Ala, or Gly
  SITE (3628)..(3628): Xaa at position 3628 is Ala, Gly, or Pro
  SITE (3633)..(3633): Xaa at position 3633 is Leu, Ala, Val, Gly, or Ile
  SITE (3637)..(3637): Xaa at position 3637 is Leu, Ala, Val, Gly, or Ile
  SITE (3645)..(3645): Xaa at position 3645 is Ile, Ala, Val, Leu, or Gly
  SITE (3649)..(3649): Xaa at position 3649 is Met, Ile, Leu, Val, Ala, or Gly
MMNEDAAQKSDSGEKFNGSSQRRKRPKKSDSNASXLRAXRAGNLDKXVEYLKGGIDINTCNQNGXNXLXXXXKEGHVGLXQEXLGRGSSVDSATKKGNTXXXIXSLAGQAEXXKVXVKEGANINAQSQNGFTPXXMXXQENHIDXXKYXLENGANQSTATEDGFTPLXXXLQQGHNQXVAIXLENDTKGKVRLPALXIXXRKDDTKSXALLXQNDHNADVQSKMMXNRTTESGFTPXXIXXHYGNVNXXTLXLNRGAAVDFTARNGITPXXXXSKRGNTNXXKLXLDRGGQIDAKTRDGLTPXXXXXRSGHDQXXELXLERGAPLLARTKNGLSPXXXXXQGDHVEXXKHXLQHKAPVDDVTLDYLTALHXXAHCGHYRXTKLXLDKRANPNARALNGFTPLHIACKKNRIKVMELLVKYGASIQAITESGLTPIHVAAFMGHLNIVLLLLQNGASPDVTNIRGETAXXMXXRAGQVEVXRCLLRNGALVDARAREEQTPXXXXSRLGKTEIXQLXLQHMAHPDAATTNGYTPXXXSXREGQVDXXSVXLEAGAAHSLATKKGFTPXXXXXKYGSLDVXKLXLQRRAAADSAGKNGLTPLHXXAHYDNQKXALLXLEKGASPHATAKNGYTPLHIAAKKNQMQIASTLLNYGAETNIVTKQGVTPLHLASQEGHTDMVTLLLDKGANIHMSTKSGLTSLHLAAQEDKVNVADILTKHGADQDAHTKLGYTPLIVACHYGNVKMVNFLLKQGANVNAKTKNGYTPLHQAAQQGHTHIINVLLQHGAKPNATTANGNTALAIAKRLGYISVVDTLKVVTEEVTTTTTTITEKHKLNVPETXTEVLDVSDEEGDDTMTGDGGEYLRPEDLKELGDDSLPSSQFLDGMNYLRYSLEGGRSDSLRSFSSDRSHTLSHASYLRDSAVMDDSVVIPSHQVSTLAKEAERNSYRLSWGTENLDNVALSSSPIHSGFLXSFMXDARGGAMRGCRHNGLRXIXPPRKCTAPTRXTXRLXKRHRLATMPPMVEGEGLXSRLXEXGPSGAQFLGKLHLPTAPPPLNEGESLVSRILQLGPPGTKFLGPXIXEXPHFXALRGKERELVVLRSENGDSWKEHFCDYTEDELNEILNGMDEVLDSPEDLEKKRICRIITRDXPQYXXXXSRIKQDSNLXGPEGGVLSSTVVPQXQXVFPEGXLTKRIRXGXQAQPMHSELVKKILGNKATFSPIXTXEPRRRKFHKPXTXTXPVPKASSDVMLNGFGGDAPTLRXXCSITGGTTPAQWEDITGTTPLTFVNECXSFTTNVSXRFXXXDXRQIQESVTFXSQXYREIICVPYMXKXVXFXKSHDPIEXRXRXXXMTDDKVDKTLEQQENFAEVARSRDVEVLEGKPIYVDCFGNXVPLTKSGQHHIFSXFAFKENRLPXFXKVRDTTQEPCGRXSXMKEPKSTRGLVHQAICNLNITLPIYTKESESDQEQEEEIDMTSEKNDETESTETSVLKSHLVNEVPVLASPDXLSEVSEMKQDLIKMTAILTTDVSDKAGSIKVKELVKAAEEEPGEPFEIVERVKEDLEKVNEILRSGTCTRDESSVQSSRSERGLVEEEWVIVSDEEIEEARQKAPLEITEYPCVEVRIDKEIKGKVEKDSTGLVNYLTDDLNTCVPLPKEQLQTVQDKAGKKCEALAVGRSSEKEGKDIPPDETQSTQKQHKPSLGIKKPVRRKLKEKQKQKEEGLQASAEKAELKKGSSEESLGEDPGLAPEPLPTVKATSPLIEETPIGSIKDKVKALQKRVEDEQKGRSKLPIRVKGKEDVPKKTTHRPHPAASPSLKSERHAPGSPSPKTERHSTLSSSAKTERHPPVSPSSKTEKHSPVSPSAKTERHSPASSSSKTEKHSPVSPSTKTERHSPVSSTKTERHPPVSPSGKTDKRPPVSPSGRTEKHPPVSPGRTEKRLPVSPSGRTDKHQPVSTAGKTEKHLPVSPSGKTEKQPPVSPTSKTERIEETMSVRELMKAFQSGQDPSKHKTGLFEHKSAKQKQPQEKGKVRVEKEKGPILTQREAQKTENQTIKRGQRLPVTGTAESKRGVRVSSIGVKKEDAAGGKEKVLSHKIPEPVQSVPEEESHRESEVPKEKMADEQGDMDLQISPDRKTSTDFSEVIKQELEDNDKYQQFRLSEETEKAQLHLDQVLTSPFNTTFPLDYMKDEFLPALSLQSGALDGSSESLKNEGVAGSPCGSLMEGTPQISSEESYKHEGLAETPETSPESLSFSPKKSEEQTGETKESTKTETTTEIRSEKEHPTTKDITGGSEERGATVTEDSETSTESFQKEATLGSPKDTSPKRQDDCTGSCSVALAKETPTGLTEEAACDEGQRTFGSSAHKTQTDSEVQESTATSDETKALPLPEASVKTDTGTESKPQGVIRSPQGLELALPSRDSEVLSAVADDSLAVSHKDSLEASPVLEDNSSHKTPDSLEPSPLKESPCRDSLESSPVEPKMKAGIFPSHFPLPAAVAKTELLTEVASVRSRLLRDPDGSAEDDSLEQTSLMESSGKSPLSPDTPSSEEVSYEVTPKTTDVSTPKPAVIHECAEEDDSENGEKKRFTPEEEMFKMVTKIKMFDELEQEAKQKRDYKKEPKQEESSSSSDPDADCSVDVDEPKHTGSGEDESGVPVLVTSESRKVSSSSESEPELAQLKKGADSGLLPEPVIRVQPPSPLPSSMDSNSSPEEVQFQPVVSKQYTFKMNEDTQEEPGKSEEEKDSESHLAEDRHAVSTEAEDRSYDKLNRDTDQPKICDGHGCEAMSPSSSAAPVSSGLQSPTGDDVDEQPVIYKESLALQGTHEKDTEGEELDVSRAESPQADCPSESFSSSSSLPHCLVSEGKELDEDISATSSIQKTEVTKTDETFENLPKDCPSQDSSITTQTDRFSMDVPVSDLAENDEIYDPQITSPYENVPSQSFFSSEESKTQTDANHTTSFHSSEVYSVTITSPVEDVVVASSSSGTVLSKESNFEGQDIKMESQQESTLWEMQSDSVSSSFEPTMSATTTVVGEQISKVIITKTDVDSDSWSEIREDDEAFEARVKEEEQKIFGLMVDRQSQGTTPDTTPARTPTEEGTPTSEQNPFLFQEGKLFEMTRSGAIDMTKRSYADESFHFFQIGQESREETLSEDVKEGATGADPLPLETSAESLALSESKETVDDEADLLPDDVSEEVEEIPASDAQLNSQMGISASTETPTKEAVSVGTKDLPTVQTGDIPPLSGVKQISCPDSSEPAVQVQLDFSTLTRSVYSDRGDDSPDSSPEEQKSVIEIPTAPMENVPFTESKSKIPVRTMPTSTPAPPSAEYESSVSEDFLSSVDEENKADEAKPKSKLPVKVPLQRVEQQLSDLDTSVQKTVAPQGQDMASIAPDNRSKSESDASSLDSKTKCPVKTRSYTETETESRERAEELELESEEGATRPKILTSRLPVKSRSTTSSCRGGTSPTKESKEHFFDLYRNSIEFFEEISDEASKLVDRLTQSEREQEIVSDDESSSALEVSVIENLPPVETEHSVPEDIFDTRPIWDESIETLIERIPDENGHDHAEDPQDEQERIEERXAYXXDHLGFSWTEXXRELDFTEEQIHQXRIENPNSLQDQSHAXXKYXLERDGKHXTDTNXVECXTKINRMDXVHLXETNTEPLQERISHSYAEIEQTITLDHSEGFSVLQEELCTAQHKQKEEQAVSKESETCDHPPIVSEEDISVGYSTFQDGVPKTEGDSSATALFPQTHKEQVQQDFSGKMQDLPEESSLEYQQEYFVTTPGTETSETQKAMIVPSSPSKTPEEVSTPAEEEKLYLQTPTSSERGGSPIIQEPEEPSEHREESSPRKTSLVIVESADNQPETCERLDEDAAFEKGDDMPEIPPETVTEEEYIDEHGHTVVKKVTRKIIRRYVSSEGTEKEEIMVQGMPQEPVNIEEGDGYSKVIKRVVLKSDTEQSEDNNE

SEQ ID NO: 623 - protein, 1670 aa, Homo sapiens
  SITE (1448)..(1448): Xaa at position 1448 is Phe, Tyr, Met, His, Ile, Leu Val, Ala, or Gly
  SITE (1474)..(1474): Xaa at position 1474 is Leu, Ala, Val, Gly, or Ile
  SITE (1475)..(1475): Xaa at position 1475 is Phe, Tyr, Met, His, Ile, Leu Val, Ala, or Gly
  SITE (1487)..(1487): Xaa at position 1487 is Leu, Ala, Val, Gly, or Ile
  SITE (1521)..(1521): Xaa at position 1521 is Tyr, Phe, Met, His, Ile, Leu Val, Ala, or Gly
  SITE (1522)..(1522): Xaa at position 1522 is Trp, Tyr, Phe, Met, His, Ile Leu, Val, Ala, or Gly
  SITE (1523)..(1523): Xaa at position 1523 is Leu, Ala, Val, Gly, or Ile
  SITE (1545)..(1545): Xaa at position 1545 is Ile, Ala, Val, Leu, or Gly
  SITE (1548)..(1548): Xaa at position 1548 is Cys, Ala, Val, Gly, Ser, or Thr
  SITE (1550)..(1550): Xaa at position 1550 is Val, Ala, Gly, Leu, or Ile
  SITE (1551)..(1551): Xaa at position 1551 is Cys, Ala, Val, Gly, Ser, or Thr
  SITE (1583)..(1583): Xaa at position 1583 is Phe, Tyr, Met, His, Ile, Leu Val, Ala, or Gly
  SITE (1586)..(1586): Xaa at position 1586 is Phe, Tyr, Met, His, Ile, Leu Val, Ala, or Gly
  SITE (1604)..(1604): Xaa at position 1604 is Cys, Ala, Val, Gly, Ser, or Thr
  SITE (1613)..(1613): Xaa at position 1613 is Phe, Tyr, Met, His, Ile, Leu Val, Ala, or Gly
  SITE (1614)..(1614): Xaa at position 1614 is Leu, Ala, Val, Gly, or Ile
  SITE (1616)..(1616): Xaa at position 1616 is Cys, Ala, Val, Gly, Ser, or Thr
  SITE (1622)..(1622): Xaa at position 1622 is Cys, Ala, Val, Gly, Ser, or Thr
  SITE (1662)..(1662): Xaa at position 1662 is Cys, Ala, Val, Gly, Ser, or Thr
  SITE (1664)..(1664): Xaa at position 1664 is Val, Ala, Gly, Leu, or Ile
  SITE (1665)..(1665): Xaa at position 1665 is Cys, Ala, Val, Gly, Ser, or Thr
  SITE (1666)..(1666): Xaa at position 1666 is Met, Ile, Leu, Val, Ala, or Gly
MSARTAPRPQVLLLPLLLVLLAAAPAASKGCVCKDKGQCFCDGAKGEKGEKGFPGPPGSPGQKGFTGPEGLPGPQGPKGFPGLPGLTGSKGVRGISGLPGFSGSPGLPGTPGNTGPYGLVGVPGCSGSKGEQGFPGLPGTLGYPGIPGAAGLKGQKGAPAKEEDIELDAKGDPGLPGAPGPQGLPGPPGFPGPVGPPGPPGFFGFPGAMGPRGPKGHMGERVIGHKGERGVKGLTGPPGPPGTVIVTLTGPDNRTDLKGEKGDKGAMGEPGPPGPSGLPGESYGSEKGAPGDPGLQGKPGKDGVPGFPGSEGVKGNRGFPGLMGEDGIKGQKGDIGPPGFRGPTEYYDTYQEKGDEGTPGPPGPRGARGPQGPSGPPGVPGSPGSSRPGLRGAPGWPGLKGSKGERGRPGKDAMGTPGSPGCAGSPGLPGSPGPPGPPGDIVFRKGPPGDHGLPGYLGSPGIPGVDGPKGEPGLLCTQCPYIPGPPGLPGLPGLHGVKGIPGRQGAAGLKGSPGSPGNTGLPGFPGFPGAQGDPGLKGEKGETLQPEGQVGVPGDPGLRGQPGRKGLDGIPGTPGVKGLPGPKGELALSGEKGDQGPPGDPGSPGSPGPAGPAGPPGYGPQGEPGLQGTQGVPGAPGPPGEAGPRGELSVSTPVPGPPGPPGPPGHPGPQGPPGIPGSLGKCGDPGLPGPDGEPGIPGIGFPGPPGPKGDQGFPGTKGSLGCPGKMGEPGLPGKPGLPGAKGEPAVAMPGGPGTPGFPGERGNSGEHGEIGLPGLPGLPGTPGNEGLDGPRGDPGQPGPPGEQGPPGRCIEGPRGAQGLPGLNGLKGQQGRRGKTGPKGDPGIPGLDRSGFPGETGSPGIPGHQGEMGPLGQRGYPGNPGILGPPGEDGVIGMMGFPGAIGPPGPPGNPGTPGQRGSPGIPGVKGQRGTPGAKGEQGDKGNPGPSEISHVIGDKGEPGLKGFAGNPGEKGNRGVPGMPGLKGLKGLPGPAGPPGPRGDLGSTGNPGEPGLRGIPGSMGNMGMPGSKGKRGTLGFPGRAGRPGLPGIHGLQGDKGEPGYSEGTRPGPPGPTGDPGLPGDMGKKGEMGQPGPPGHLGPAGPEGAPGSPGSPGLPGKPGPHGDLGFKGIKGLLGPPGIRGPPGLPGFPGSPGPMGIRGDQGRDGIPGPAGEKGETGLLRAPPGPRGNPGAQGAKGDRGAPGFPGLPGRKGAMGDAGPRGPTGIEGFPGPPGLPGAIIPGQTGNRGPPGSRGSPGAPGPPGPPGSHVIGIKGDKGSMGHPGPKGPPGTAGDMGPPGRLGAPGTPGLPGPRGDPGFQGFPGVKGEKGNPGFLGSIGPPGPIGPKGPPGVRGDPGTLKIISLPGSPGPPGTPGEPGMQGEPGPPGPPGNLGPCGPRGKPGKDGKPGTPGPAGEKGNKGSKGEPGPAGSDGLPGLKGKRGDSGSPATWTTRGFVXTRHSQTTAIPSCPEGTVPLYSGFSFXXVQGNQRAHGQDXGTLGSCLQRFTTMPFLFCNVNDVCNFASRNDYSXXXSTPALMPMNMAPITGRALEPYXSRXTXXEGPAIAIAVHSQTTDIPPCPHGWISLWKGFSXIMXTSAGSEGTGQALASPGSXLEEFRASPXXEXHGRGTXNYYSNSYSFWLASLNPERMFRKPIPSTVKAGELEKIISRXQXXXKKRH

SEQ ID NO: 624 - protein, 901 aa, Homo sapiens
  SITE (28)..(28): Xaa at position 28 is Cys, Ala, Val, Gly, Ser, or Thr
  SITE (30)..(30): Xaa at position 30 is Leu, Ala, Val, Gly, or Ile
  SITE (32)..(32): Xaa at position 32 is Leu, Ala, Val, Gly, or Ile
  SITE (33)..(33): Xaa at position 33 is Ala, Gly, or Pro
  SITE (41)..(41): Xaa at position 41 is Leu, Ala, Val, Gly, or Ile
  SITE (42)..(42): Xaa at position 42 is Ile, Ala, Val, Leu, or Gly
  SITE (43)..(43): Xaa at position 43 is Ile, Ala, Val, Leu, or Gly
  SITE (56)..(56): Xaa at position 56 is Ile, Ala, Val, Leu, or Gly
  SITE (58)..(58): Xaa at position 58 is Ile, Ala, Val, Leu, or Gly
  SITE (62)..(62): Xaa at position 62 is Phe, Tyr, Met, His, Ile, Leu, Val Ala, or Gly
  SITE (64)..(64): Xaa at position 64 is Cys, Ala, Val, Gly, Ser, or Thr
  SITE (82)..(82): Xaa at position 82 is Cys, Ala, Val, Gly, Ser, or Thr
  SITE (84)..(84): Xaa at position 84 is Ile, Ala, Val, Leu, or Gly
  SITE (86)..(86): Xaa at position 86 is Val, Ala, Gly, Leu, or Ile
  SITE (96)..(96): Xaa at position 96 is Phe, Tyr, Met, His, Ile, Leu, Val Ala, or Gly
  SITE (98)..(98): Xaa at position 98 is Ile, Ala, Val, Leu, or Gly
  SITE (104)..(104): Xaa at position 104 is Cys, Ala, Val, Gly, Ser, or Thr
  SITE (107)..(107): Xaa at position 107 is Phe, Tyr, Met, His, Ile, Leu, Val Ala, or Gly
  SITE (108)..(108): Xaa at position 108 is Leu, Ala, Val, Gly, or Ile
  SITE (111)..(111): Xaa at position 111 is Val, Ala, Gly, Leu, or Ile
  SITE (114)..(114): Xaa at position 114 is Ala, Gly, or Pro
  SITE (242)..(242): Xaa at position 242 is Phe, Tyr, Met, His, Ile, Leu, Val Ala, or Gly
  SITE (243)..(243): Xaa at position 243 is Phe, Tyr, Met, His, Ile, Leu, Val Ala, or Gly
  SITE (244)..(244): Xaa at position 244 is Val, Ala, Gly, Leu, or Ile
  SITE (247)..(247): Xaa at position 247 is Trp, Tyr, Phe, Met, His, Ile, Leu Val, Ala, or Gly
  SITE (249)..(249): Xaa at position 249 is Val, Ala, Gly, Leu, or Ile
  SITE (258)..(258): Xaa at position 258 is Leu, Ala, Val, Gly, or Ile
  SITE (261)..(261): Xaa at position 261 is Trp, Tyr, Phe, Met, His, Ile, Leu Val, Ala, or Gly
  SITE (262)..(262): Xaa at position 262 is Leu, Ala, Val, Gly, or Ile
  SITE (271)..(271): Xaa at position 271 is Ile, Ala, Val, Leu, or Gly
  SITE (272)..(272): Xaa at position 272 is Tyr, Phe, Met, His, Ile, Leu, Val Ala, or Gly
  SITE (273)..(273): Xaa at position 273 is Cys, Ala, Val, Gly, Ser, or Thr
  SITE (274)..(274): Xaa at position 274 is Ile, Ala, Val, Leu, or Gly
  SITE (276)..(276): Xaa at position 276 is Phe, Tyr, Met, His, Ile, Leu, Val Ala, or Gly
  SITE (279)..(279): Xaa at position 279 is Leu, Ala, Val, Gly, or Ile
  SITE (285)..(285): Xaa at position 285 is Ala, Gly, or Pro
  SITE (297)..(297): Xaa at position 297 is Trp, Tyr, Phe, Met, His, Ile, Leu Val, Ala, or Gly
  SITE (301)..(301): Xaa at position 301 is Val, Ala, Gly, Leu, or Ile
  SITE (322)..(322): Xaa at position 322 is Met, Ile, Leu, Val, Ala, or Gly
  SITE (323)..(323): Xaa at position 323 is Met, Ile, Leu, Val, Ala, or Gly
  SITE (324)..(324): Xaa at position 324 is Leu, Ala, Val, Gly, or Ile
  SITE (325)..(325): Xaa at position 325 is Leu, Ala, Val, Gly, or Ile
  SITE (326)..(326): Xaa at position 326 is Ile, Ala, Val, Leu, or Gly
  SITE (327)..(327): Xaa at position 327 is Phe, Tyr, Met, His, Ile, Leu, Val Ala, or Gly
  SITE (328)..(328): Xaa at position 328 is Ala, Gly, or Pro
  SITE (358)..(358): Xaa at position 358 is Val, Ala, Gly, Leu, or Ile
  SITE (359)..(359): Xaa at position 359 is Ala, Gly, or Pro
  SITE (360)..(360): Xaa at position 360 is Val, Ala, Gly, Leu, or Ile
  SITE (362)..(362): Xaa at position 362 is Phe, Tyr, Met, His, Ile, Leu, Val Ala, or Gly
  SITE (364)..(364): Xaa at position 364 is Phe, Tyr, Met, His, Ile, Leu, Val Ala, or Gly
  SITE (369)..(369): Xaa at position 369 is Phe, Tyr, Met, His, Ile, Leu, Val Ala, or Gly
  SITE (370)..(370): Xaa at position 370 is Cys, Ala, Val, Gly, Ser, or Thr
  SITE (371)..(371): Xaa at position 371 is Ile, Ala, Val, Leu, or Gly
  SITE (372)..(372): Xaa at position 372 is Val, Ala, Gly, Leu, or Ile
  SITE (376)..(376): Xaa at position 376 is Leu, Ala, Val, Gly, or Ile
  SITE (393)..(393): Xaa at position 393 is Ile, Ala, Val, Leu, or Gly
  SITE (399)..(399): Xaa at position 399 is Phe, Tyr, Met, His, Ile, Leu, Val Ala, or Gly
  SITE (411)..(411): Xaa at position 411 is Ile, Ala, Val, Leu, or Gly
  SITE (417)..(417): Xaa at position 417 is Val, Ala, Gly, Leu, or Ile
  SITE (419)..(419): Xaa at position 419 is Trp, Tyr, Phe, Met, His, Ile, Leu Val, Ala, or Gly
  SITE (420)..(420): Xaa at position 420 is Leu, Ala, Val, Gly, or Ile
  SITE (423)..(423): Xaa at position 423 is Leu, Ala, Val, Gly, or Ile
  SITE (425)..(425): Xaa at position 425 is Tyr, Phe, Met, His, Ile, Leu, Val Ala, or Gly
  SITE (435)..(435): Xaa at position 435 is Val, Ala, Gly, Leu, or Ile
  SITE (447)..(447): Xaa at position 447 is Leu, Ala, Val, Gly, or Ile
  SITE (453)..(453): Xaa at position 453 is Leu, Ala, Val, Gly, or Ile
  SITE (479)..(479): Xaa at position 479 is Tyr, Phe, Met, His, Ile, Leu, Val Ala, or Gly
  SITE (496)..(496): Xaa at position 496 is Ala, Gly, or Pro
  SITE (497)..(497): Xaa at position 497 is Trp, Tyr, Phe, Met, His, Ile, Leu Val, Ala, or Gly
  SITE (498)..(498): Xaa at position 498 is Cys, Ala, Val, Gly, Ser, or Thr
  SITE (501)..(501): Xaa at position 501 is Ile, Ala, Val, Leu, or Gly
  SITE (502)..(502): Xaa at position 502 is Leu, Ala, Val, Gly, or Ile
  SITE (519)..(519): Xaa at position 519 is Leu, Ala, Val, Gly, or Ile
  SITE (527)..(527): Xaa at position 527 is Val, Ala, Gly, Leu, or Ile
  SITE (529)..(529): Xaa at position 529 is Ala, Gly, or Pro
  SITE (531)..(531): Xaa at position 531 is Phe, Tyr, Met, His, Ile, Leu, Val Ala, or Gly
  SITE (533)..(533): Xaa at position 533 is Ile, Ala, Val, Leu, or Gly
  SITE (535)..(535): Xaa at position 535 is Val, Ala, Gly, Leu, or Ile
  SITE (572)..(572): Xaa at position 572 is Phe, Tyr, Met, His, Ile, Leu, Val Ala, or Gly
  SITE (574)..(574): Xaa at position 574 is Phe, Tyr, Met, His, Ile, Leu, Val Ala, or Gly
  SITE (577)..(577): Xaa at position 577 is Val, Ala, Gly, Leu, or Ile
  SITE (589)..(589): Xaa at position 589 is Ile, Ala, Val, Leu, or Gly
  SITE (599)..(599): Xaa at position 599 is Phe, Tyr, Met, His, Ile, Leu, Val Ala, or Gly
  SITE (614)..(614): Xaa at position 614 is Trp, Tyr, Phe, Met, His, Ile, Leu Val, Ala, or Gly
  SITE (617)..(617): Xaa at position 617 is Ala, Gly, or Pro
  SITE (624)..(624): Xaa at position 624 is Leu, Ala, Val, Gly, or Ile
  SITE (632)..(632): Xaa at position 632 is Ile, Ala, Val, Leu, or Gly
  SITE (634)..(634): Xaa at position 634 is Leu, Ala, Val, Gly, or Ile
  SITE (636)..(636): Xaa at position 636 is Val, Ala, Gly, Leu, or Ile
  SITE (638)..(638): Xaa at position 638 is Val, Ala, Gly, Leu, or Ile
  SITE (643)..(643): Xaa at position 643 is Val, Ala, Gly, Leu, or Ile
  SITE (657)..(657): Xaa at position 657 is Leu, Ala, Val, Gly, or Ile
  SITE (659)..(659): Xaa at position 659 is Leu, Ala, Val, Gly, or Ile
  SITE (661)..(661): Xaa at position 661 is Leu, Ala, Val, Gly, or Ile
  SITE (669)..(669): Xaa at position 669 is Leu, Ala, Val, Gly, or Ile
  SITE (679)..(679): Xaa at position 679 is Cys, Ala, Val, Gly, Ser, or Thr
  SITE (680)..(680): Xaa at position 680 is Phe, Tyr, Met, His, Ile, Leu, Val Ala, or Gly
  SITE (684)..(684): Xaa at position 684 is Leu, Ala, Val, Gly, or Ile
  SITE (687)..(687): Xaa at position 687 is Leu, Ala, Val, Gly, or Ile
  SITE (688)..(688): Xaa at position 688 is Cys, Ala, Val, Gly, Ser, or Thr
  SITE (738)..(738): Xaa at position 738 is Ile, Ala, Val, Leu, or Gly
  SITE (741)..(741): Xaa at position 741 is Leu, Ala, Val, Gly, or Ile
  SITE (742)..(742): Xaa at position 742 is Val, Ala, Gly, Leu, or Ile
  SITE (745)..(745): Xaa at position 745 is Leu, Ala, Val, Gly, or Ile
  SITE (749)..(749): Xaa at position 749 is Ala, Gly, or Pro
  SITE (755)..(755): Xaa at position 755 is Leu, Ala, Val, Gly, or Ile
  SITE (765)..(765): Xaa at position 765 is Leu, Ala, Val, Gly, or Ile
  SITE (768)..(768): Xaa at position 768 is Ile, Ala, Val, Leu, or Gly
  SITE (772)..(772): Xaa at position 772 is Leu, Ala, Val, Gly, or Ile
  SITE (787)..(787): Xaa at position 787 is Val, Ala, Gly, Leu, or Ile
  SITE (788)..(788): Xaa at position 788 is Ala, Gly, or Pro
  SITE (790)..(790): Xaa at position 790 is Ala, Gly, or Pro
  SITE (791)..(791): Xaa at position 791 is Leu, Ala, Val, Gly, or Ile
  SITE (794)..(794): Xaa at position 794 is Phe, Tyr, Met, His, Ile, Leu, Val Ala, or Gly
  SITE (795)..(795): Xaa at position 795 is Leu, Ala, Val, Gly, or Ile
  SITE (802)..(802): Xaa at position 802 is Val, Ala, Gly, Leu, or Ile
  SITE (803)..(803): Xaa at position 803 is Ile, Ala, Val, Leu, or Gly
  SITE (811)..(811): Xaa at position 811 is Cys, Ala, Val, Gly, Ser, or Thr
  SITE (812)..(812): Xaa at position 812 is Leu, Ala, Val, Gly, or Ile
  SITE (824)..(824): Xaa at position 824 is Val, Ala, Gly, Leu, or Ile
  SITE (825)..(825): Xaa at position 825 is Ile, Ala, Val, Leu, or Gly
  SITE (828)..(828): Xaa at position 828 is Leu, Ala, Val, Gly, or Ile
  SITE (835)..(835): Xaa at position 835 is Val, Ala, Gly, Leu, or Ile
  SITE (836)..(836): Xaa at position 836 is Phe, Tyr, Met, His, Ile, Leu, Val Ala, or Gly
  SITE (839)..(839): Xaa at position 839 is Leu, Ala, Val, Gly, or Ile
  SITE (842)..(842): Xaa at position 842 is Phe, Tyr, Met, His, Ile, Leu, Val Ala, or Gly
  SITE (843)..(843): Xaa at position 843 is Leu, Ala, Val, Gly, or Ile
  SITE (846)..(846): Xaa at position 846 is Leu, Ala, Val, Gly, or Ile
  SITE (855)..(855): Xaa at position 855 is Val, Ala, Gly, Leu, or Ile
  SITE (860)..(860): Xaa at position 860 is Ile, Ala, Val, Leu, or Gly
  SITE (861)..(861): Xaa at position 861 is Ala, Gly, or Pro
  SITE (864)..(864): Xaa at position 864 is Phe, Tyr, Met, His, Ile, Leu, Val Ala, or Gly
  SITE (868)..(868): Xaa at position 868 is Leu, Ala, Val, Gly, or Ile
  SITE (890)..(890): Xaa at position 890 is Phe, Tyr, Met, His, Ile, Leu, Val Ala, or Gly
  SITE (891)..(891): Xaa at position 891 is Leu, Ala, Val, Gly, or Ile
MEPPLPVGAQPLATVEGMEMKGPLREPXAXTXXQRNGQYEXXXQLHEKEQHVQDIXPXNSHXRXVQEAEETLLIDIASNSGXKXRXQGDWIRERRXEXPDEEHXLKXXSAXLAXQKAQSQLLVPEQKDSSSWYQKLDTKDKPSVFSGLLGFEDNFSSMNLDKKINSQNQPTGIHREPPPPPFSVNKMLPREKEASNKEQPKVTNTMRKLFVPNTQSGQREGLIKHILAKREKEYVNIQTFRXXXGTXNXNGQSPDSGXEPXXNCDPNPPDXXXXGXQEXDLSTEXFFYFESVKEQEXSMAXERGLHSKAKYKKVQLVRLVGXXXXXXXRKDQCRYIRDIATETVGTGIMGKMGNKGGXXXRXVXHNTTXXXXNSHXAAHVEDFERRNQDYKDXCARMSXVVPNQTLPQLNXMKHEVXIXXGDXNXRLCMPDANEXKSLINKKDLQRXLKFDQXNIQRTQKKAFVDFNEGEIKFIPTYKXDSKTDRWDSSGKCRVPXXXDRXXWRGTNVNQLNYRSHMEXKTSDHKPXSXLXHXGXKVVDERRYRKVFEDSVRIMDRMENDFLPSLELSRREXVXENXKFRQLQKEKFQXSNNGQVPCHXSFIPKLNDSQYCKPXLRXEPFEGYXEPNETVDXSXDXYXSKDSXTILNSGEDKIEDIXVXHXDRGKDYFXTISGNYLPSXXGTSXEAXXRMKRPIREVPVTKLIDLEEDSFLEKEKSLLQMVPLDEGASERPLQVPKEXWLXXDHXFKYXCHQEDXFQTPGMQEEXQQXIDCXDTSIPETIPGSNHSXXEXXLIXXEALPEPXXCYELYQRXXDSAYDPRICRQXXSQXPRCHRNXXRYXMAXXREXLKFSEYNSXNANMXXTLXTSLXLRPPPNLMARQTPSDRQRAIQXXLGFLLGSEED

SEQ ID NO: 625 - protein, 184 aa, Homo sapiens
  SITE (24)..(24): Xaa at position 24 is Cys, Ala, Val, Gly, Ser, or Thr
  SITE (37)..(37): Xaa at position 37 is Cys, Ala, Val, Gly, Ser, or Thr
  SITE (41)..(41): Xaa at position 41 is Cys, Ala, Val, Gly, Ser, or Thr
MLQMAGQCSQNEYFDSLLHACIPXQLRCSSNTPPLTXQRYXNASVTNSVKGTNAILWTCLGLSLIISLAVFVLMFLLRKINSEPLKDEFKNTGSGLLGMANIDLEKSRTGDEIILPRGLEYTVEECTCEDCIKSKPKVDSDHCFPLPAMEEGATILVTTKTNDYCKSLPAALSATEIEKSISAR

SEQ ID NO: 626 - protein, 640 aa, Homo sapiens
  SITE (196)..(196): Xaa at position 196 is Cys, Ala, Val, Gly, Ser, or Thr
  SITE (221)..(221): Xaa at position 221 is Cys, Ala, Val, Gly, Ser, or Thr
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGEXFMVKDLSNPSRYLCKCQPGFTGARXTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 627 - protein, 2944 aa, Homo sapiens
  SITE (2876)..(2876): Xaa at position 2876 is Cys, Ala, Val, Gly, Ser, or Thr
  SITE (2925)..(2925): Xaa at position 2925 is Cys, Ala, Val, Gly, Ser, or Thr
MTLRLLVAALCAGILAEAPRVRAQHRERVTCTRLYAADIVFLLDGSSSIGRSNFREVRSFLEGLVLPFSGAASAQGVRFATVQYSDDPRTEFGLDALGSGGDVIRAIRELSYKGGNTRTGAAILHVADHVFLPQLARPGVPKVCILITDGKSQDLVDTAAQRLKGQGVKLFAVGIKNADPEELKRVASQPTSDFFFFVNDFSILRTLLPLVSRRVCTTAGGVPVTRPPDDSTSAPRDLVLSEPSSQSLRVQWTAASGPVTGYKVQYTPLTGLGQPLPSERQEVNVPAGETSVRLRGLRPLTEYQVTVIALYANSIGEAVSGTARTTALEGPELTIQNTTAHSLLVAWRSVPGATGYRVTWRVLSGGPTQQQELGPGQGSVLLRDLEPGTDYEVTVSTLFGRSVGPATSLMARTDASVEQTLRPVILGPTSILLSWNLVPEARGYRLEWRRETGLEPPQKVVLPSDVTRYQLDGLQPGTEYRLTLYTLLEGHEVATPATVVPTGPELPVSPVTDLQATELPGQRVRVSWSPVPGATQYRIIVRSTQGVERTLVLPGSQTAFDLDDVQAGLSYTVRVSARVGPREGSASVLTVRREPETPLAVPGLRVVVSDATRVRVAWGPVPGASGFRISWSTGSGPESSQTLPPDSTATDITGLQPGTTYQVAVSVLRGREEGPAAVIVARTDPLGPVRTVHVTQASSSSVTITWTRVPGATGYRVSWHSAHGPEKSQLVSGEATVAELDGLEPDTEYTVHVRAHVAGVDGPPASVVVRTAPEPVGRVSRLQILNASSDVLRITWVGVTGATAYRLAWGRSEGGPMRHQILPGNTDSAEIRGLEGGVSYSVRVTALVGDREGTPVSIVVTTPPEAPPALGTLHVVQRGEHSLRLRWEPVPRAQGFLLHWQPEGGQEQSRVLGPELSSYHLDGLEPATQYRVRLSVLGPAGEGPSAEVTARTESPRVPSIELRVVDTSIDSVTLAWTPVSRASSYILSWRPLRGPGQEVPGSPQTLPGISSSQRVTGLEPGVSYIFSLTPVLDGVRGPEASVTQTPVCPRGLADVVFLPHATQDNAHRAEATRRVLERLVLALGPLGPQAVQVGLLSYSHRPSPLFPLNGSHDLGIILQRIRDMPYMDPSGNNLGTAVVTAHRYMLAPDAPGRRQHVPGVMVLLVDEPLRGDIFSPIREAQASGLNVVMLGMAGADPEQLRRLAPGMDSVQTFFAVDDGPSLDQAVSGLATALCQASFTTQPRPEPCPVYCPKGQKGEPGEMGLRGQVGPPGDPGLPGRTGAPGPQGPPGSATAKGERGFPGADGRPGSPGRAGNPGTPGAPGLKGSPGLPGPRGDPGERGPRGPKGEPGAPGQVIGGEGPGLPGRKGDPGPSGPPGPRGPLGDPGPRGPPGLPGTAMKGDKGDRGERGPPGPGEGGIAPGEPGLPGLPGSPGPQGPVGPPGKKGEKGDSEDGAPGLPGQPGSPGEQGPRGPPGAIGPKGDRGFPGPLGEAGEKGERGPPGPAGSRGLPGVAGRPGAKGPEGPPGPTGRQGEKGEPGRPGDPAVVGPAVAGPKGEKGDVGPAGPRGATGVQGERGPPGLVLPGDPGPKGDPGDRGPIGLTGRAGPPGDSGPPGEKGDPGRPGPPGPVGPRGRDGEVGEKGDEGPPGDPGLPGKAGERGLRGAPGVRGPVGEKGDQGDPGEDGRNGSPGSSGPKGDRGEPGPPGPPGRLVDTGPGAREKGEPGDRGQEGPRGPKGDPGLPGAPGERGIEGFRGPPGPQGDPGVRGPAGEKGDRGPPGLDGRSGLDGKPGAAGPSGPNGAAGKAGDPGRDGLPGLRGEQGLPGPSGPPGLPGKPGEDGKPGLNGKNGEPGDPGEDGRKGEKGDSGASGREGRDGPKGERGAPGILGPQGPPGLPGPVGPPGQGFPGVPGGTGPKGDRGETGSKGEQGLPGERGLRGEPGSVPNVDRLLETAGIKASALREIVETWDESSGSFLPVPERRRGPKGDSGEQGPPGKEGPIGFPGERGLKGDRGDPGPQGPPGLALGERGPPGPSGLAGEPGKPGIPGLPGRAGGVGEAGRPGERGERGEKGERGEQGRDGPPGLPGTPGPPGPPGPKVSVDEPGPGLSGEQGPPGLKGAKGEPGSNGDQGPKGDRGVPGIKGDRGEPGPRGQDGNPGLPGERGMAGPEGKPGLQGPRGPPGPVGGHGDPGPPGAPGLAGPAGPQGPSGLKGEPGETGPPGRGLTGPTGAVGLPGPPGPSGLVGPQGSPGLPGQVGETGKPGAPGRDGASGKDGDRGSPGVPGSPGLPGPVGPKGEPGPTGAPGQAVVGLPGAKGEKGAPGGLAGDLVGEPGAKGDRGLPGPRGEKGEAGRAGEPGDPGEDGQKGAPGPKGFKGDPGVGVPGSPGPPGPPGVKGDLGLPGLPGAPGVVGFPGQTGPRGEMGQPGPSGERGLAGPPGREGIPGPLGPPGPPGSVGPPGASGLKGDKGDPGVGLPGPRGERGEPGIRGEDGRPGQEGPRGLTGPPGSRGERGEKGDVGSAGLKGDKGDSAVILGPPGPRGAKGDMGERGPRGLDGDKGPRGDNGDPGDKGSKGEPGDKGSAGLPGLRGLLGPQGQPGAAGIPGDPGSPGKDGVPGIRGEKGDVGFMGPRGLKGERGVKGACGLDGEKGDKGEAGPPGRPGLAGHKGEMGEPGVPGQSGAPGKEGLIGPKGDRGFDGQPGPKGDQGEKGERGTPGIGGFPGPSGNDGSAGPPGPPGSVGPRGPEGLQGQKGERGPPGERVVGAPGVPGAPGERGEQGRPGPAGPRGEKGEAALTEDDIRGFVRQEMSQHCACQGQFIASGSRPLPSYAADTAGSQLHAVPVLRVSHAEEEERVPPEDDEYSEYSEYSVEEYQDPEAPWDSDDPXSLPLDEGSCTAYTLRWYHRAVTGSTEACHPFVYGGCGGNANRFGTREAXERRCPPRVVQSQGTGTAQD

SEQ ID NO: 628 - protein, 1049 aa, Homo sapiens
  SITE (58)..(58): Xaa at position 58 is Cys, Ala, Val, Gly, Ser, or Thr
  SITE (70)..(70): Xaa at position 70 is Ile, Ala, Val, Leu, or Gly
  SITE (71)..(71): Xaa at position 71 is Ala, Gly, or Pro
  SITE (73)..(73): Xaa at position 73 is Ile, Ala, Val, Leu, or Gly
  SITE (83)..(83): Xaa at position 83 is Val, Ala, Gly, Leu, or Ile
  SITE (85)..(85): Xaa at position 85 is Tyr, Phe, Met, His, Ile, Leu, Val Ala, or Gly
  SITE (100)..(100): Xaa at position 100 is Phe, Tyr, Met, His, Ile, Leu, Val Ala, or Gly
  SITE (109)..(109): Xaa at position 109 is Ile, Ala, Val, Leu, or Gly
  SITE (111)..(111): Xaa at position 111 is Ile, Ala, Val, Leu, or Gly
  SITE (115)..(115): Xaa at position 115 is Val, Ala, Gly, Leu, or Ile
  SITE (123)..(123): Xaa at position 123 is Phe, Tyr, Met, His, Ile, Leu, Val Ala, or Gly
  SITE (125)..(125): Xaa at position 125 is Ile, Ala, Val, Leu, or Gly
  SITE (127)..(127): Xaa at position 127 is Cys, Ala, Val, Gly, Ser, or Thr
  SITE (129)..(129): Xaa at position 129 is Ala, Gly, or Pro
  SITE (143)..(143): Xaa at position 143 is Leu, Ala, Val, Gly, or Ile
  SITE (145)..(145): Xaa at position 145 is Val, Ala, Gly, Leu, or Ile
  SITE (147)..(147): Xaa at position 147 is Val, Ala, Gly, Leu, or Ile
  SITE (179)..(179): Xaa at position 179 is Leu, Ala, Val, Gly, or Ile
  SITE (218)..(218): Xaa at position 218 is Ile, Ala, Val, Leu, or Gly
  SITE (225)..(225): Xaa at position 225 is Leu, Ala, Val, Gly, or Ile
  SITE (235)..(235): Xaa at position 235 is Leu, Ala, Val, Gly, or Ile
  SITE (237)..(237): Xaa at position 237 is Val, Ala, Gly, Leu, or Ile
  SITE (255)..(255): Xaa at position 255 is Cys, Ala, Val, Gly, Ser, or Thr
  SITE (257)..(257): Xaa at position 257 is Ile, Ala, Val, Leu, or Gly
  SITE (259)..(259): Xaa at position 259 is Ile, Ala, Val, Leu, or Gly
  SITE (290)..(290): Xaa at position 290 is Ile, Ala, Val, Leu, or Gly
  SITE (305)..(305): Xaa at position 305 is Ala, Gly, or Pro
  SITE (331)..(331): Xaa at position 331 is Leu, Ala, Val, Gly, or Ile
  SITE (333)..(333): Xaa at position 333 is Val, Ala, Gly, Leu, or Ile
  SITE (337)..(337): Xaa at position 337 is Leu, Ala, Val, Gly, or Ile
  SITE (347)..(347): Xaa at position 347 is Leu, Ala, Val, Gly, or Ile
  SITE (349)..(349): Xaa at position 349 is Ile, Ala, Val, Leu, or Gly
  SITE (351)..(351): Xaa at position 351 is Val, Ala, Gly, Leu, or Ile
  SITE (372)..(372): Xaa at position 372 is Ile, Ala, Val, Leu, or Gly
  SITE (374)..(374): Xaa at position 374 is Val, Ala, Gly, Leu, or Ile
  SITE (376)..(376): Xaa at position 376 is Val, Ala, Gly, Leu, or Ile
  SITE (394)..(394): Xaa at position 394 is Val, Ala, Gly, Leu, or Ile
  SITE (409)..(409): Xaa at position 409 is Ala, Gly, or Pro
  SITE (423)..(423): Xaa at position 423 is Tyr, Phe, Met, His, Ile, Leu, Val Ala, or Gly
  SITE (433)..(433): Xaa at position 433 is Leu, Ala, Val, Gly, or Ile
  SITE (442)..(442): Xaa at position 442 is Leu, Ala, Val, Gly, or Ile
  SITE (460)..(460): Xaa at position 460 is Tyr, Phe, Met, His, Ile, Leu, Val Ala, or Gly
  SITE (464)..(464): Xaa at position 464 is Ile, Ala, Val, Leu, or Gly
  SITE (479)..(479): Xaa at position 479 is Ile, Ala, Val, Leu, or Gly
  SITE (481)..(481): Xaa at position 481 is Ile, Ala, Val, Leu, or Gly
MDWSFFRVVAMLFIFLVVVEVNSEFRIQVRDYNTKNGTIKWHSIRRQKREWIKFAAAXREGEDNSKRNPXXKXHSDCAANQQXTXRISGVGIDQPPYGIXVINQKTGEXNXTSIXDREVTPFXIXYXRXLNSMGQDLERPLEXRXRXLDINDNPPVFSMATFAGQIEENSNANTLVMIXNATDADEPNNLNSKIAFKIIRQEPSDSPMFIINRNTGEXRTMNNFXDREQYGQYAXAXRGSDRDGGADGMSAECEXNXKXLDVNDNIPYMEQSSYTIEIQENTLNSNLLEXRVIDLDEEFSANWMXVIFFISGNEGNWFEIEMNERTNVGIXKXVKPXDYEAMQSLQXSXGXRNKAEFHHSIMSQYKLKASAXSXTXLNVIEGPVFRPGSKTYVXTGNMGSNDKVGDFVXTDLDTGRPSTTVRXVMGNNPADLXAVDSRTGKXTLKNKVTKEQYNMLGGKXQGTXLSIDDNLQRTCTGTXNXNIQSFGNDDRTNTEPNTKITTNTGRQESTSSTNYDTSTTSTDSSQVYSSEPGNGAKDLLSDNVHFGPAGIGLLIMGFLVLGLVPFLMICCDCGGAPRSAAGFEPVPECSDGAIHSWAVEGPQPEPRDITTVIPQIPPDNANIIECIDNSGVYTNEYGGREMQDLGGGERMTGFELTEGVKTSGMPEICQEYSGTLRRNSMRECREGGLNMNFMESYFCQKAYAYADEDEGRPSNDCLLIYDIEGVGSPAGSVGCCSFIGEDLDDSFLDTLGPKFKKLADISLGKESYPDLDPSWPPQSTEPVCLPQETEPVVSGHPPISPHFGTTTVISESTYPSGPGVLHPKPILDPLGYGNVTVTESYTTSDTLKPSVHVHDNRPASNVVVTERVVGPISGADLHGMLEMPDLRDGSNVIVTERVIAPSSSLPTSLTIHHPRESSNVVVTERVIQPTSGMIGSLSMHPELANAHNVIVTERVVSGAGVTGISGTTGISGGIGSSGLVGTSMGAGSGALSGAGISGGGIGLSSLGGTASIGHMRSSSDHHFNQTIGSASPSTARSRITKYSTVQYSK

SEQ ID NO: 629 - protein, 901 aa, Homo sapiens
  SITE (185)..(185): Xaa at position 185 is Leu, Ala, Val, Gly, or Ile
  SITE (195)..(195): Xaa at position 195 is Leu, Ala, Val, Gly, or Ile
  SITE (201)..(201): Xaa at position 201 is Val, Ala, Gly, Leu, or Ile
  SITE (209)..(209): Xaa at position 209 is Phe, Tyr, Met, His, Ile, Leu, Val Ala, or Gly
  SITE (211)..(211): Xaa at position 211 is Ile, Ala, Val, Leu, or Gly
  SITE (231)..(231): Xaa at position 231 is Ile, Ala, Val, Leu, or Gly
  SITE (233)..(233): Xaa at position 233 is Ile, Ala, Val, Leu, or Gly
  SITE (252)..(252): Xaa at position 252 is Ile, Ala, Val, Leu, or Gly
  SITE (304)..(304): Xaa at position 304 is Ile, Ala, Val, Leu, or Gly
  SITE (311)..(311): Xaa at position 311 is Leu, Ala, Val, Gly, or Ile
  SITE (319)..(319): Xaa at position 319 is Tyr, Phe, Met, His, Ile, Leu, Val Ala, or Gly
  SITE (321)..(321): Xaa at position 321 is Leu, Ala, Val, Gly, or Ile
  SITE (323)..(323): Xaa at position 323 is Ile, Ala, Val, Leu, or Gly
  SITE (325)..(325): Xaa at position 325 is Val, Ala, Gly, Leu, or Ile
  SITE (341)..(341): Xaa at position 341 is Cys, Ala, Val, Gly, Ser, or Thr
  SITE (343)..(343): Xaa at position 343 is Ile, Ala, Val, Leu, or Gly
  SITE (376)..(376): Xaa at position 376 is Val, Ala, Gly, Leu, or Ile
  SITE (404)..(404): Xaa at position 404 is Phe, Tyr, Met, His, Ile, Leu, Val Ala, or Gly
  SITE (417)..(417): Xaa at position 417 is Leu, Ala, Val, Gly, or Ile
  SITE (419)..(419): Xaa at position 419 is Val, Ala, Gly, Leu, or Ile
  SITE (433)..(433): Xaa at position 433 is Leu, Ala, Val, Gly, or Ile
  SITE (435)..(435): Xaa at position 435 is Ile, Ala, Val, Leu, or Gly
  SITE (437)..(437): Xaa at position 437 is Val, Ala, Gly, Leu, or Ile
  SITE (458)..(458): Xaa at position 458 is Val, Ala, Gly, Leu, or Ile
  SITE (460)..(460): Xaa at position 460 is Val, Ala, Gly, Leu, or Ile
  SITE (495)..(495): Xaa at position 495 is Ala, Gly, or Pro
  SITE (506)..(506): Xaa at position 506 is Ile, Ala, Val, Leu, or Gly
  SITE (517)..(517): Xaa at position 517 is Trp, Tyr, Phe, Met, His, Ile, Leu Val, Ala, or Gly
  SITE (533)..(533): Xaa at position 533 is Leu, Ala, Val, Gly, or Ile
  SITE (545)..(545): Xaa at position 545 is Tyr, Phe, Met, His, Ile, Leu, Val Ala, or Gly
  SITE (547)..(547): Xaa at position 547 is Ile, Ala, Val, Leu, or Gly
  SITE (551)..(551): Xaa at position 551 is Ala, Gly, or Pro
  SITE (563)..(563): Xaa at position 563 is Leu, Ala, Val, Gly, or Ile
  SITE (565)..(565): Xaa at position 565 is Ile, Ala, Val, Leu, or Gly
  SITE (584)..(584): Xaa at position 584 is Ile, Ala, Val, Leu, or Gly
  SITE (585)..(585): Xaa at position 585 is Cys, Ala, Val, Gly, Ser, or Thr
  SITE (633)..(633): Xaa at position 633 is Ala, Gly, or Pro
  SITE (635)..(635): Xaa at position 635 is Leu, Ala, Val, Gly, or Ile
  SITE (648)..(648): Xaa at position 648 is Val, Ala, Gly, Leu, or Ile
  SITE (650)..(650): Xaa at position 650 is Ile, Ala, Val, Leu, or Gly
  SITE (652)..(652): Xaa at position 652 is Val, Ala, Gly, Leu, or Ile
  SITE (664)..(664): Xaa at position 664 is Leu, Ala, Val, Gly, or Ile
  SITE (666)..(666): Xaa at position 666 is Val, Ala, Gly, Leu, or Ile
MEAARPSGSWNGALCRLLLLTLAILIFASDACKNVTLHVPSKLDAEKLVGRVNLKECFTAANLIHSSDPDFQILEDGSVYTTNTILLSSEKRSFTILLSNTENQEKKKIFVFLEHQTKVLKKRHTKEKVLRRAKRRWAPIPCSMLENSLGPFPLFLQQVQSDTAQNYTIYYSIRGPGVDQEPRNXFYVERDTGNXYCTRPXDREQYESXEXIAFATTPDGYTPELPLPLIXKXEDENDNYPIFTEETYTFTXFENCRVGTTVGQVCATDKDEPDTMHTRLKYSIIGQVPPSPTLFSMHPTTGVXTTTSSQXDRELIDKXQXKXKXQDMDGQYFGLQTTSTXIXNIDDVNDHLPTFTRTSYVTSVEENTVDVEILRXTVEDKDLVNTANWRANYTILKGNENGNXKIVTDAKTNEGVXCXVKPLNYEEKQQMIXQXGXVNEAPFSREASPRSAMSTATXTXNVEDQDEGPECNPPIQTVRMKENAEVGTTSNGYKXYDPETRSSSGXRYKKLTDPTGXVTIDENTGSIKVFRSXDREAETIKNGIXNXTVLXSDQGGRTCTGTXGXILQDVNDNSPFIPKKTVIXXKPTMSSAEIVAVDPDEPIHGPPFDFSLESSTSEVQRMWRLKAINDTAXRXSYQNDPPFGSYVXPXTXRDRLGMSSVTSXDXTLCDCITENDCTHRVDPRIGGGGVQLGKWAILAILLGIALLFCILFTLVCGASGTSKQPKVIPDDLAQQNLIVSNTEAPGDDKVYSANGFTTQTVGASAQGVCGTVGSGIKNGGQETIEMVKGGHQTSESCRGAGHHHTLDSCRGGHTEVDNCRYTYSEWHSFTQPRLGEKVYLCNQDENHKHAQDYVLTYNYEGRGSVAGSVGCCSERQEEDGLEFLDNLEPKFRTLAEACMKR

SEQ ID NO: 630 - protein, 408 aa, Homo sapiens
  SITE (19)..(19): Xaa at position 19 is Tyr, Phe, Met, His, Ile, Leu, Val Ala, or Gly
  SITE (20)..(20): Xaa at position 20 is Leu, Ala, Val, Gly, or Ile
  SITE (34)..(34): Xaa at position 34 is Ala, Gly, or Pro
  SITE (38)..(38): Xaa at position 38 is Phe, Tyr, Met, His, Ile, Leu, Val Ala, or Gly
  SITE (42)..(42): Xaa at position 42 is Ala, Gly, or Pro
  SITE (52)..(52): Xaa at position 52 is Val, Ala, Gly, Leu, or Ile
  SITE (60)..(60): Xaa at position 60 is Val, Ala, Gly, Leu, or Ile
  SITE (62)..(62): Xaa at position 62 is Val, Ala, Gly, Leu, or Ile
  SITE (63)..(63): Xaa at position 63 is Leu, Ala, Val, Gly, or Ile
  SITE (80)..(80): Xaa at position 80 is His, Phe, Tyr, Lys, Arg, Gly, Ser Thr, Ala, Val, Leu, Ile, Asn, Met, or Gln
  SITE (83)..(83): Xaa at position 83 is Val, Ala, Gly, Leu, or Ile
  SITE (98)..(98): Xaa at position 98 is Ala, Gly, or Pro
  SITE (114)..(114): Xaa at position 114 is Met, Ile, Leu, Val, Ala, or Gly
  SITE (122)..(122): Xaa at position 122 is Leu, Ala, Val, Gly, or Ile
  SITE (141)..(141): Xaa at position 141 is Met, Ile, Leu, Val, Ala, or Gly
  SITE (158)..(158): Xaa at position 158 is Phe, Tyr, Met, His, Ile, Leu, Val Ala, or Gly
MTSKGPEEEHPSVTLFRQXXRIRTVQPKPDYGAXVAFXEETXRQLGLGCQKXEVAPGYVXTXXTWPGTNPTLSSILLNSXTDXVPVFKEHWSHDPFEXFKDSEGYIYARGAQDXKCVSIQYXEAVRRLKVEGHRFPRTIHXTFVPDEEVGGHQGMELXVQRPEFHALRAGFALDEGIANPTDAFTVFYSERSPWWVRVTSTGRPGHASRFMEDTAAEKLHKVVNSILAFREKEWQRLQSNPHLKEGSVTSVNLTKLEGGVAYNVIPATMSASFDFRVAPDVDFKAFEEQLQSWCQAAGEGVTLEFAQKWMHPQVTPTDDSNPWWAAFSRVCKDMNLTLEPEIMPAATDNRYIRAVGVPALGFSPMNRTPVLLHDHDERLHEAVFLRGVDIYTRLLPALASVPALPSDS

SEQ ID NO: 631 - protein, 129 aa, Homo sapiens
  SITE (31)..(31): Xaa at position 31 is Cys, Ala, Val, Gly, Ser, or Thr
  SITE (52)..(52): Xaa at position 52 is Cys, Ala, Val, Gly, Ser, or Thr
  SITE (58)..(58): Xaa at position 58 is Cys, Ala, Val, Gly, Ser, or Thr
  SITE (69)..(69): Xaa at position 69 is Cys, Ala, Val, Gly, Ser, or Thr
  SITE (70)..(70): Xaa at position 70 is Phe, Tyr, Met, His, Ile, Leu, Val Ala, or Gly
  SITE (73)..(73): Xaa at position 73 is Leu, Ala, Val, Gly, or Ile
  SITE (81)..(81): Xaa at position 81 is Cys, Ala, Val, Gly, Ser, or Thr
  SITE (101)..(101): Xaa at position 101 is Cys, Ala, Val, Gly, Ser, or Thr
  SITE (118)..(118): Xaa at position 118 is Cys, Ala, Val, Gly, Ser, or Thr
  SITE (119)..(119): Xaa at position 119 is Phe, Tyr, Met, His, Ile, Leu, Val Ala, or Gly
MGRRDAQLLAALLVLGLCALAGSEKPSPCQXSRLSPHNRTNCGFPGITSDQXFDNGCXFDSSVTGVPWXXHPXPKQESDQXVMEVSDRRNCGYPGISPEEXASRKCCFSNFIFEVPWXXFPKSVEDCHY

SEQ ID NO: 632 - protein, 396 aa, Homo sapiens
  SITE (8)..(8): Xaa at position 8 is Val, Ala, Gly, Leu, or Ile
  SITE (10)..(10): Xaa at position 10 is Ala, Gly, or Pro
  SITE (14)..(14): Xaa at position 14 is Val, Ala, Gly, Leu, or Ile
  SITE (20)..(20): Xaa at position 20 is His, Phe, Tyr, Lys, Arg, Gly, Ser Thr, Ala, Val, Leu, Ile, Asn, Met, or Gln
  SITE (21)..(21): Xaa at position 21 is Ala, Gly, or Pro
  SITE (27)..(27): Xaa at position 27 is Val, Ala, Gly, Leu, or Ile
  SITE (29)..(29): Xaa at position 29 is Leu, Ala, Val, Gly, or Ile
  SITE (31)..(31): Xaa at position 31 is Val, Ala, Gly, Leu, or Ile
  SITE (33)..(33): Xaa at position 33 is Leu, Ala, Val, Gly, or Ile
  SITE (39)..(39): Xaa at position 39 is Leu, Ala, Val, Gly, or Ile
  SITE (41)..(41): Xaa at position 41 is Leu, Ala, Val, Gly, or Ile
  SITE (49)..(49): Xaa at position 49 is Val, Ala, Gly, Leu, or Ile
  SITE (51)..(51): Xaa at position 51 is Leu, Ala, Val, Gly, or Ile
  SITE (91)..(91): Xaa at position 91 is Leu, Ala, Val, Gly, or Ile
  SITE (109)..(109): Xaa at position 109 is Val, Ala, Gly, Leu, or Ile
  SITE (111)..(111): Xaa at position 111 is Ala, Gly, or Pro
  SITE (112)..(112): Xaa at position 112 is Phe, Tyr, Met, His, Ile, Leu, Val Ala, or Gly
  SITE (113)..(113): Xaa at position 113 is Leu, Ala, Val, Gly, or Ile
  SITE (115)..(115): Xaa at position 115 is Leu, Ala, Val, Gly, or Ile
  SITE (116)..(116): Xaa at position 116 is Tyr, Phe, Met, His, Ile, Leu, Val Ala, or Gly
  SITE (117)..(117): Xaa at position 117 is Leu, Ala, Val, Gly, or Ile
  SITE (119)..(119): Xaa at position 119 is Ile, Ala, Val, Leu, or Gly
  SITE (120)..(120): Xaa at position 120 is Cys, Ala, Val, Gly, Ser, or Thr
  SITE (129)..(129): Xaa at position 129 is Leu, Ala, Val, Gly, or Ile
  SITE (143)..(143): Xaa at position 143 is Leu, Ala, Val, Gly, or Ile
  SITE (147)..(147): Xaa at position 147 is Ala, Gly, or Pro
  SITE (148)..(148): Xaa at position 148 is Ala, Gly, or Pro
  SITE (151)..(151): Xaa at position 151 is Val, Ala, Gly, Leu, or Ile
  SITE (152)..(152): Xaa at position 152 is Cys, Ala, Val, Gly, Ser, or Thr
  SITE (153)..(153): Xaa at position 153 is Leu, Ala, Val, Gly, or Ile
  SITE (154)..(154): Xaa at position 154 is Ala, Gly, or Pro
  SITE (155)..(155): Xaa at position 155 is Ala, Gly, or Pro
  SITE (156)..(156): Xaa at position 156 is Ala, Gly, or Pro
  SITE (157)..(157): Xaa at position 157 is Leu, Ala, Val, Gly, or Ile
  SITE (158)..(158): Xaa at position 158 is Leu, Ala, Val, Gly, or Ile
  SITE (185)..(185): Xaa at position 185 is Ile, Ala, Val, Leu, or Gly
  SITE (189)..(189): Xaa at position 189 is Ala, Gly, or Pro
  SITE (206)..(206): Xaa at position 206 is Ala, Gly, or Pro
  SITE (207)..(207): Xaa at position 207 is Val, Ala, Gly, Leu, or Ile
  SITE (213)..(213): Xaa at position 213 is Ala, Gly, or Pro
  SITE (214)..(214): Xaa at position 214 is Leu, Ala, Val, Gly, or Ile
  SITE (233)..(233): Xaa at position 233 is Leu, Ala, Val, Gly, or Ile
  SITE (234)..(234): Xaa at position 234 is Leu, Ala, Val, Gly, or Ile
  SITE (250)..(250): Xaa at position 250 is Val, Ala, Gly, Leu, or Ile
  SITE (268)..(268): Xaa at position 268 is Ile, Ala, Val, Leu, or Gly
  SITE (275)..(275): Xaa at position 275 is Cys, Ala, Val, Gly, Ser, or Thr
  SITE (282)..(282): Xaa at position 282 is Met, Ile, Leu, Val, Ala, or Gly
  SITE (305)..(305): Xaa at position 305 is Leu, Ala, Val, Gly, or Ile
  SITE (310)..(310): Xaa at position 310 is Val, Ala, Gly, Leu, or Ile
  SITE (315)..(315): Xaa at position 315 is Leu, Ala, Val, Gly, or Ile
  SITE (318)..(318): Xaa at position 318 is Leu, Ala, Val, Gly, or Ile
  SITE (331)..(331): Xaa at position 331 is Leu, Ala, Val, Gly, or Ile
  SITE (339)..(339): Xaa at position 339 is Cys, Ala, Val, Gly, Ser, or Thr
  SITE (353)..(353): Xaa at position 353 is Val, Ala, Gly, Leu, or Ile
  SITE (360)..(360): Xaa at position 360 is Leu, Ala, Val, Gly, or Ile
  SITE (374)..(374): Xaa at position 374 is Ala, Gly, or Pro
  SITE (377)..(377): Xaa at position 377 is Val, Ala, Gly, Leu, or Ile
  SITE (379)..(379): Xaa at position 379 is Ile, Ala, Val, Leu, or Gly
MLSEVLLXSXPGKXILHGEXXVVHGKXAXAXSXNLRTFXRXQPHSNGKXDXSLPNIGIKRAWDVARLQSLDTSFLEQGDVTTPTSEQVEKXKEVAGLPDDCAVTERLAXLXXXYXXXSXXRKQRALPSXDIVVWSELPPGAGXGSSXXYSXXXXXXXXTVCEEIPNPLKDGDCVNRWTKEDLELXNKWXFQGERMIHGNPSGVDNXXSTWGGXXRYHQGKISSLKRSPALQIXXTNTKVPRNTRALVAGXRNRLLKFPEIVAPLLTSXDAISLEXERVLGEXGEAPAPEQYLVLEELIDMNQHHXNALGXGHASXDQXCQVTRARGLHSKXTGAGGGGXGITLLKPGLEQPEXEATKQAXTSCGFDCLETSIGXPGXSXHSATSLDSRVQQALDGL

SEQ ID NO: 633 - protein, 330 aa, Homo sapiens
  SITE (53)..(53): Xaa at position 53 is Tyr, Phe, Met, His, Ile, Leu, Val Ala, or Gly
  SITE (70)..(70): Xaa at position 70 is Ile, Ala, Val, Leu, or Gly
  SITE (87)..(87): Xaa at position 87 is Cys, Ala, Val, Gly, Ser, or Thr
  SITE (110)..(110): Xaa at position 110 is Val, Ala, Gly, Leu, or Ile
  SITE (127)..(127): Xaa at position 127 is Ile, Ala, Val, Leu, or Gly
  SITE (129)..(129): Xaa at position 129 is Cys, Ala, Val, Gly, Ser, or Thr
  SITE (249)..(249): Xaa at position 249 is Ile, Ala, Val, Leu, or Gly
  SITE (251)..(251): Xaa at position 251 is Cys, Ala, Val, Gly, Ser, or Thr
  SITE (266)..(266): Xaa at position 266 is Cys, Ala, Val, Gly, Ser, or Thr
  SITE (296)..(296): Xaa at position 296 is Ala, Gly, or Pro
  SITE (317)..(317): Xaa at position 317 is Cys, Ala, Val, Gly, Ser, or Thr
MWLLVSVILISRISSVGGEATFCDFPKINHGILYDEEKYKPFSQVPTGEVFYXSCEYNFVSPSKSFWTRXTCTEEGWSPTPKCLRLXFFPFVENGHSESSGQTHLEGDTXQIICNTGYRLQNNENNXSXVERGWSTPPKCRSTDTSCVNPPTVQNAHILSRQMSKYPSGERVRYECRSPYEMFGDEEVMCLNGNWTEPPQCKDSTGKCGPPPPIDNGDITSFPLSVYAPASSVEYQCQNLYQLEGNKRXTXRNGQWSEPPKCLHPXVISREIMENYNIALRWTAKQKLYLRTGESXEFVCKRGYRLSSRSHTLRTTXWDGKLEYPTCAKR

SEQ ID NO: 634 - protein, 702 aa, Homo sapiens
  SITE (31)..(31): Xaa at position 31 is Leu, Ala, Val, Gly, or Ile
  SITE (38)..(38): Xaa at position 38 is Leu, Ala, Val, Gly, or Ile
  SITE (45)..(45): Xaa at position 45 is Phe, Tyr, Met, His, Ile, Leu, Val Ala, or Gly
  SITE (59)..(59): Xaa at position 59 is Ile, Ala, Val, Leu, or Gly
  SITE (69)..(69): Xaa at position 69 is Phe, Tyr, Met, His, Ile, Leu, Val Ala, or Gly
  SITE (88)..(88): Xaa at position 88 is Cys, Ala, Val, Gly, Ser, or Thr
  SITE (92)..(92): Xaa at position 92 is Ala, Gly, or Pro
  SITE (95)..(95): Xaa at position 95 is Ala, Gly, or Pro
  SITE (98)..(98): Xaa at position 98 is Val, Ala, Gly, Leu, or Ile
  SITE (100)..(100): Xaa at position 100 is Leu, Ala, Val, Gly, or Ile
  SITE (136)..(136): Xaa at position 136 is Val, Ala, Gly, Leu, or Ile
  SITE (142)..(142): Xaa at position 142 is Leu, Ala, Val, Gly, or Ile
  SITE (144)..(144): Xaa at position 144 is Val, Ala, Gly, Leu, or Ile
  SITE (145)..(145): Xaa at position 145 is Val, Ala, Gly, Leu, or Ile
  SITE (146)..(146): Xaa at position 146 is Ile, Ala, Val, Leu, or Gly
  SITE (157)..(157): Xaa at position 157 is Ile, Ala, Val, Leu, or Gly
  SITE (161)..(161): Xaa at position 161 is Ala, Gly, or Pro
  SITE (164)..(164): Xaa at position 164 is Val, Ala, Gly, Leu, or Ile
  SITE (197)..(197): Xaa at position 197 is Leu, Ala, Val, Gly, or Ile
  SITE (199)..(199): Xaa at position 199 is Ile, Ala, Val, Leu, or Gly
  SITE (200)..(200): Xaa at position 200 is Tyr, Phe, Met, His, Ile, Leu, Val Ala, or Gly
  SITE (203)..(203): Xaa at position 203 is His, Phe, Tyr, Lys, Arg, Gly, Ser Thr, Ala, Val, Leu, Ile, Asn, Met, or Gln
  SITE (204)..(204): Xaa at position 204 is Val, Ala, Gly, Leu, or Ile
  SITE (206)..(206): Xaa at position 206 is Ile, Ala, Val, Leu, or Gly
  SITE (216)..(216): Xaa at position 216 is Tyr, Phe, Met, His, Ile, Leu, Val Ala, or Gly
  SITE (219)..(219): Xaa at position 219 is Phe, Tyr, Met, His, Ile, Leu, Val Ala, or Gly
  SITE (223)..(223): Xaa at position 223 is Val, Ala, Gly, Leu, or Ile
  SITE (224)..(224): Xaa at position 224 is Leu, Ala, Val, Gly, or Ile
  SITE (227)..(227): Xaa at position 227 is Ile, Ala, Val, Leu, or Gly
  SITE (230)..(230): Xaa at position 230 is Leu, Ala, Val, Gly, or Ile
  SITE (232)..(232): Xaa at position 232 is Tyr, Phe, Met, His, Ile, Leu, Val Ala, or Gly
  SITE (234)..(234): Xaa at position 234 is Cys, Ala, Val, Gly, Ser, or Thr
  SITE (235)..(235): Xaa at position 235 is Ile, Ala, Val, Leu, or Gly
  SITE (237)..(237): Xaa at position 237 is Leu, Ala, Val, Gly, or Ile
  SITE (238)..(238): Xaa at position 238 is Met, Ile, Leu, Val, Ala, or Gly
  SITE (240)..(240): Xaa at position 240 is Ile, Ala, Val, Leu, or Gly
  SITE (241)..(241): Xaa at position 241 is Met, Ile, Leu, Val, Ala, or Gly
  SITE (243)..(243): Xaa at position 243 is His, Phe, Tyr, Lys, Arg, Gly, Ser Thr, Ala, Val, Leu, Ile, Asn, Met, or Gln
  SITE (249)..(249): Xaa at position 249 is Phe, Tyr, Met, His, Ile, Leu, Val Ala, or Gly
  SITE (253)..(253): Xaa at position 253 is Ile, Ala, Val, Leu, or Gly
  SITE (256)..(256): Xaa at position 256 is Phe, Tyr, Met, His, Ile, Leu, Val Ala, or Gly
  SITE (257)..(257): Xaa at position 257 is Phe, Tyr, Met, His, Ile, Leu, Val Ala, or Gly
  SITE (258)..(258): Xaa at position 258 is Ala, Gly, or Pro
  SITE (259)..(259): Xaa at position 259 is Ala, Gly, or Pro
  SITE (269)..(269): Xaa at position 269 is Leu, Ala, Val, Gly, or Ile
  SITE (272)..(272): Xaa at position 272 is Leu, Ala, Val, Gly, or Ile
  SITE (273)..(273): Xaa at position 273 is Val, Ala, Gly, Leu, or Ile
  SITE (276)..(276): Xaa at position 276 is Ala, Gly, or Pro
  SITE (281)..(281): Xaa at position 281 is Ile, Ala, Val, Leu, or Gly
  SITE (283)..(283): Xaa at position 283 is Val, Ala, Gly, Leu, or Ile
  SITE (284)..(284): Xaa at position 284 is Leu, Ala, Val, Gly, or Ile
  SITE (285)..(285): Xaa at position 285 is Leu, Ala, Val, Gly, or Ile
  SITE (287)..(287): Xaa at position 287 is Val, Ala, Gly, Leu, or Ile
  SITE (288)..(288): Xaa at position 288 is Val, Ala, Gly, Leu, or Ile
  SITE (289)..(289): Xaa at position 289 is His, Phe, Tyr, Lys, Arg, Gly, Ser Thr, Ala, Val, Leu, Ile, Asn, Met, or Gln
  SITE (292)..(292): Xaa at position 292 is Ala, Gly, or Pro
  SITE (300)..(300): Xaa at position 300 is Leu, Ala, Val, Gly, or Ile
  SITE (303)..(303): Xaa at position 303 is Phe, Tyr, Met, His, Ile, Leu, Val Ala, or Gly
  SITE (310)..(310): Xaa at position 310 is Tyr, Phe, Met, His, Ile, Leu, Val Ala, or Gly
  SITE (311)..(311): Xaa at position 311 is Phe, Tyr, Met, His, Ile, Leu, Val Ala, or Gly
  SITE (319)..(319): Xaa at position 319 is His, Phe, Tyr, Lys, Arg, Gly, Ser Thr, Ala, Val, Leu, Ile, Asn, Met, or Gln
  SITE (334)..(334): Xaa at position 334 is Ile, Ala, Val, Leu, or Gly
  SITE (335)..(335): Xaa at position 335 is Leu, Ala, Val, Gly, or Ile
  SITE (337)..(337): Xaa at position 337 is Phe, Tyr, Met, His, Ile, Leu, Val Ala, or Gly
  SITE (338)..(338): Xaa at position 338 is Leu, Ala, Val, Gly, or Ile
  SITE (339)..(339): Xaa at position 339 is Leu, Ala, Val, Gly, or Ile
  SITE (342)..(342): Xaa at position 342 is Ile, Ala, Val, Leu, or Gly
  SITE (345)..(345): Xaa at position 345 is Trp, Tyr, Phe, Met, His, Ile, Leu Val, Ala, or Gly
  SITE (346)..(346): Xaa at position 346 is Leu, Ala, Val, Gly, or Ile
  SITE (349)..(349): Xaa at position 349 is Tyr, Phe, Met, His, Ile, Leu, Val Ala, or Gly
  SITE (351)..(351): Xaa at position 351 is Phe, Tyr, Met, His, Ile, Leu, Val Ala, or Gly
  SITE (354)..(354): Xaa at position 354 is Phe, Tyr, Met, His, Ile, Leu, Val Ala, or Gly
  SITE (356)..(356): Xaa at position 356 is Phe, Tyr, Met, His, Ile, Leu, Val Ala, or Gly
  SITE (359)..(359): Xaa at position 359 is Val, Ala, Gly, Leu, or Ile
  SITE (362)..(362): Xaa at position 362 is Met, Ile, Leu, Val, Ala, or Gly
  SITE (363)..(363): Xaa at position 363 is Leu, Ala, Val, Gly, or Ile
  SITE (364)..(364): Xaa at position 364 is Tyr, Phe, Met, His, Ile, Leu, Val Ala, or Gly
  SITE (389)..(389): Xaa at position 389 is Ala, Gly, or Pro
  SITE (390)..(390): Xaa at position 390 is Leu, Ala, Val, Gly, or Ile
  SITE (392)..(392): Xaa at position 392 is Tyr, Phe, Met, His, Ile, Leu, Val Ala, or Gly
  SITE (393)..(393): Xaa at position 393 is Leu, Ala, Val, Gly, or Ile
  SITE (394)..(394): Xaa at position 394 is Met, Ile, Leu, Val, Ala, or Gly
  SITE (395)..(395): Xaa at position 395 is Leu, Ala, Val, Gly, or Ile
  SITE (396)..(396): Xaa at position 396 is Ala, Gly, or Pro
  SITE (399)..(399): Xaa at position 399 is Leu, Ala, Val, Gly, or Ile
  SITE (400)..(400): Xaa at position 400 is Val, Ala, Gly, Leu, or Ile
  SITE (410)..(410): Xaa at position 410 is Ile, Ala, Val, Leu, or Gly
  SITE (411)..(411): Xaa at position 411 is Ala, Gly, or Pro
  SITE (417)..(417): Xaa at position 417 is Met, Ile, Leu, Val, Ala, or Gly
  SITE (419)..(419): Xaa at position 419 is Ala, Gly, or Pro
  SITE (420)..(420): Xaa at position 420 is Leu, Ala, Val, Gly, or Ile
  SITE (439)..(439): Xaa at position 439 is Ile, Ala, Val, Leu, or Gly
  SITE (443)..(443): Xaa at position 443 is Trp, Tyr, Phe, Met, His, Ile, Leu Val, Ala, or Gly
  SITE (446)..(446): Xaa at position 446 is Leu, Ala, Val, Gly, or Ile
  SITE (455)..(455): Xaa at position 455 is Trp, Tyr, Phe, Met, His, Ile, Leu Val, Ala, or Gly
  SITE (457)..(457): Xaa at position 457 is Met, Ile, Leu, Val, Ala, or Gly
  SITE (460)..(460): Xaa at position 460 is Ile, Ala, Val, Leu, or Gly
  SITE (464)..(464): Xaa at position 464 is Leu, Ala, Val, Gly, or Ile
  SITE (474)..(474): Xaa at position 474 is Ile, Ala, Val, Leu, or Gly
  SITE (475)..(475): Xaa at position 475 is Ala, Gly, or Pro
  SITE (476)..(476): Xaa at position 476 is Tyr, Phe, Met, His, Ile, Leu, Val Ala, or Gly
  SITE (477)..(477): Xaa at position 477 is Ala, Gly, or Pro
  SITE (480)..(480): Xaa at position 480 is His, Phe, Tyr, Lys, Arg, Gly, Ser Thr, Ala, Val, Leu, Ile, Asn, Met, or Gln
  SITE (490)..(490): Xaa at position 490 is Leu, Ala, Val, Gly, or Ile
  SITE (491)..(491): Xaa at position 491 is Ala, Gly, or Pro
  SITE (503)..(503): Xaa at position 503 is Met, Ile, Leu, Val, Ala, or Gly
  SITE (513)..(513): Xaa at position 513 is Ile, Ala, Val, Leu, or Gly
  SITE (517)..(517): Xaa at position 517 is Ile, Ala, Val, Leu, or Gly
  SITE (519)..(519): Xaa at position 519 is Leu, Ala, Val, Gly, or Ile
  SITE (520)..(520): Xaa at position 520 is His, Phe, Tyr, Lys, Arg, Gly, Ser Thr, Ala, Val, Leu, Ile, Asn, Met, or Gln
  SITE (522)..(522): Xaa at position 522 is Met, Ile, Leu, Val, Ala, or Gly
  SITE (523)..(523): Xaa at position 523 is Ile, Ala, Val, Leu, or Gly
  SITE (525)..(525): Xaa at position 525 is Leu, Ala, Val, Gly, or Ile
  SITE (526)..(526): Xaa at position 526 is Ile, Ala, Val, Leu, or Gly
  SITE (528)..(528): Xaa at position 528 is His, Phe, Tyr, Lys, Arg, Gly, Ser Thr, Ala, Val, Leu, Ile, Asn, Met, or Gln
  SITE (530)..(530): Xaa at position 530 is Leu, Ala, Val, Gly, or Ile
  SITE (535)..(535): Xaa at position 535 is Tyr, Phe, Met, His, Ile, Leu, Val Ala, or Gly
  SITE (536)..(536): Xaa at position 536 is Leu, Ala, Val, Gly, or Ile
  SITE (538)..(538): Xaa at position 538 is Phe, Tyr, Met, His, Ile, Leu, Val Ala, or Gly
  SITE (539)..(539): Xaa at position 539 is Met, Ile, Leu, Val, Ala, or Gly
  SITE (543)..(543): Xaa at position 543 is Phe, Tyr, Met, His, Ile, Leu, Val Ala, or Gly
  SITE (549)..(549): Xaa at position 549 is Leu, Ala, Val, Gly, or Ile
  SITE (551)..(551): Xaa at position 551 is Phe, Tyr, Met, His, Ile, Leu, Val Ala, or Gly
  SITE (563)..(563): Xaa at position 563 is Ala, Gly, or Pro
  SITE (580)..(580): Xaa at position 580 is Leu, Ala, Val, Gly, or Ile
  SITE (583)..(583): Xaa at position 583 is Phe, Tyr, Met, His, Ile, Leu, Val Ala, or Gly
  SITE (587)..(587): Xaa at position 587 is Met, Ile, Leu, Val, Ala, or Gly
  SITE (590)..(590): Xaa at position 590 is Leu, Ala, Val, Gly, or Ile
  SITE (596)..(596): Xaa at position 596 is Trp, Tyr, Phe, Met, His, Ile, Leu Val, Ala, or Gly
  SITE (597)..(597): Xaa at position 597 is Leu, Ala, Val, Gly, or Ile
  SITE (613)..(613): Xaa at position 613 is Ile, Ala, Val, Leu, or Gly
  SITE (614)..(614): Xaa at position 614 is Ile, Ala, Val, Leu, or Gly
  SITE (615)..(615): Xaa at position 615 is Ala, Gly, or Pro
  SITE (616)..(616): Xaa at position 616 is Phe, Tyr, Met, His, Ile, Leu, Val Ala, or Gly
  SITE (621)..(621): Xaa at position 621 is Leu, Ala, Val, Gly, or Ile
  SITE (622)..(622): Xaa at position 622 is Leu, Ala, Val, Gly, or Ile
  SITE (623)..(623): Xaa at position 623 is Phe, Tyr, Met, His, Ile, Leu, Val Ala, or Gly
  SITE (624)..(624): Xaa at position 624 is Ile, Ala, Val, Leu, or Gly
  SITE (625)..(625): Xaa at position 625 is Phe, Tyr, Met, His, Ile, Leu, Val Ala, or Gly
  SITE (638)..(638): Xaa at position 638 is Val, Ala, Gly, Leu, or Ile
  SITE (646)..(646): Xaa at position 646 is Phe, Tyr, Met, His, Ile, Leu, Val Ala, or Gly
  SITE (650)..(650): Xaa at position 650 is Leu, Ala, Val, Gly, or Ile
  SITE (654)..(654): Xaa at position 654 is Ala, Gly, or Pro
  SITE (683)..(683): Xaa at position 683 is Leu, Ala, Val, Gly, or Ile
  SITE (685)..(685): Xaa at position 685 is Val, Ala, Gly, Leu, or Ile
  SITE (687)..(687): Xaa at position 687 is Ile, Ala, Val, Leu, or Gly
  SITE (691)..(691): Xaa at position 691 is Val, Ala, Gly, Leu, or Ile
  SITE (692)..(692): Xaa at position 692 is Ala, Gly, or Pro
  SITE (693)..(693): Xaa at position 693 is Leu, Ala, Val, Gly, or Ile
  SITE (694)..(694): Xaa at position 694 is Ile, Ala, Val, Leu, or Gly
  SITE (695)..(695): Xaa at position 695 is Leu, Ala, Val, Gly, or Ile
  SITE (698)..(698): Xaa at position 698 is Val, Ala, Gly, Leu, or Ile
MAAPMTPAARPEDYEAALNAALADVPELARXLEIDPYXKPYAVDXQRRYKQFSQILKNXGENEGGIDKXSRGYESFGVHRCADGGLYXKEWXPGXEGXFXTGDFNGWNPFSYPYKKLDYGKWELYIPPKQNKSVLXPHGSKXKXXXTSKSGEILYRXSPWXKYXVREGDNVNYDWIHWDPEHSYEFKHSRPKKPRSXRXXESXXGXSSHEGKVASXKHXTCNXXPRXKGXGXNXXQXXAXXEXAYYASXGYQXTSXXXXSSRYGTPEEXQEXXDTXHSMGXIXXXDXXXSHXSKNSADGXNMXDGTDSCXXHSGPRGTXDLWDSRLFAYSSWEXXRXXXSNXRWXXEEXRXDGXRXDGXTSXXXHHHGVGQGFSGDYSEYFGLQVDEDXXTXXXXXNHXXHTLCPDSITXXEDVSGXPXXCSPISQGGGGFDYRLAMAXPDKXIQXLKEFKDEDXNXGDXVYTXTNRRYLEKCXXXXESXDQALVGDKSXXFWLMDAEMYTNXSVLTPFTPVXDRGXQXXKXXRXXTXGXGGEGXXNXXGNEXGHPEWXDXPRKGNNESYHYXRRQFHLTDDDLLRYKFXNNXDRDXNRXEERYGXXAAPQAYVSEKHEGNKXXXXERAGXXXXXNFHPSKSYTDYRXGTALPGKXKIVXDSDXAEYGGHQRLDHSTDFFSEAFEHNGRPYSXLXYXPSRXXXXXQNXDLPN

SEQ ID NO: 635 - protein, 750 aa, Homo sapiens
  SITE (61)..(61): Xaa at position 61 is Phe, Tyr, Met, His, Ile, Leu, Val Ala, or Gly
  SITE (70)..(70): Xaa at position 70 is Ile, Ala, Val, Leu, or Gly
  SITE (74)..(74): Xaa at position 74 is Leu, Ala, Val, Gly, or Ile
  SITE (77)..(77): Xaa at position 77 is Phe, Tyr, Met, His, Ile, Leu, Val Ala, or Gly
  SITE (83)..(83): Xaa at position 83 is Leu, Ala, Val, Gly, or Ile
  SITE (84)..(84): Xaa at position 84 is Ala, Gly, or Pro
  SITE (93)..(93): Xaa at position 93 is Ala, Gly, or Pro
  SITE (108)..(108): Xaa at position 108 is Val, Ala, Gly, Leu, or Ile
  SITE (110)..(110): Xaa at position 110 is Leu, Ala, Val, Gly, or Ile
  SITE (113)..(113): Xaa at position 113 is Tyr, Phe, Met, His, Ile, Leu, Val Ala, or Gly
  SITE (115)..(115): Xaa at position 115 is Val, Ala, Gly, Leu, or Ile
  SITE (117)..(117): Xaa at position 117 is Leu, Ala, Val, Gly, or Ile
  SITE (128)..(128): Xaa at position 128 is Ile, Ala, Val, Leu, or Gly
  SITE (130)..(130): Xaa at position 130 is Ile, Ala, Val, Leu, or Gly
  SITE (158)..(158): Xaa at position 158 is Val, Ala, Gly, Leu, or Ile
  SITE (161)..(161): Xaa at position 161 is Phe, Tyr, Met, His, Ile, Leu, Val Ala, or Gly
  SITE (163)..(163): Xaa at position 163 is Ala, Gly, or Pro
  SITE (164)..(164): Xaa at position 164 is Phe, Tyr, Met, His, Ile, Leu, Val Ala, or Gly
  SITE (174)..(174): Xaa at position 174 is Leu, Ala, Val, Gly, or Ile
  SITE (175)..(175): Xaa at position 175 is Val, Ala, Gly, Leu, or Ile
  SITE (176)..(176): Xaa at position 176 is Tyr, Phe, Met, His, Ile, Leu, Val Ala, or Gly
  SITE (177)..(177): Xaa at position 177 is Val, Ala, Gly, Leu, or Ile
  SITE (180)..(180): Xaa at position 180 is Ala, Gly, or Pro
  SITE (188)..(188): Xaa at position 188 is Leu, Ala, Val, Gly, or Ile
  SITE (196)..(196): Xaa at position 196 is Cys, Ala, Val, Gly, Ser, or Thr
  SITE (200)..(200): Xaa at position 200 is Ile, Ala, Val, Leu, or Gly
  SITE (201)..(201): Xaa at position 201 is Val, Ala, Gly, Leu, or Ile
  SITE (202)..(202): Xaa at position 202 is Ile, Ala, Val, Leu, or Gly
  SITE (203)..(203): Xaa at position 203 is Ala, Gly, or Pro
  SITE (214)..(214): Xaa at position 214 is Val, Ala, Gly, Leu, or Ile
  SITE (217)..(217): Xaa at position 217 is Ala, Gly, or Pro
  SITE (225)..(225): Xaa at position 225 is Val, Ala, Gly, Leu, or Ile
  SITE (226)..(226): Xaa at position 226 is Ile, Ala, Val, Leu, or Gly
  SITE (227)..(227): Xaa at position 227 is Leu, Ala, Val, Gly, or Ile
  SITE (228)..(228): Xaa at position 228 is Tyr, Phe, Met, His, Ile, Leu, Val Ala, or Gly
  SITE (234)..(234): Xaa at position 234 is Tyr, Phe, Met, His, Ile, Leu, Val Ala, or Gly
  SITE (236)..(236): Xaa at position 236 is Ala, Gly, or Pro
  SITE (253)..(253): Xaa at position 253 is Val, Ala, Gly, Leu, or Ile
  SITE (258)..(258): Xaa at position 258 is Ile, Ala, Val, Leu, or Gly
  SITE (259)..(259): Xaa at position 259 is Leu, Ala, Val, Gly, or Ile
  SITE (264)..(264): Xaa at position 264 is Ala, Gly, or Pro
  SITE (268)..(268): Xaa at position 268 is Leu, Ala, Val, Gly, or Ile
  SITE (274)..(274): Xaa at position 274 is Ala, Gly, or Pro
  SITE (287)..(287): Xaa at position 287 is Val, Ala, Gly, Leu, or Ile
  SITE (294)..(294): Xaa at position 294 is Val, Ala, Gly, Leu, or Ile
  SITE (297)..(297): Xaa at position 297 is Ile, Ala, Val, Leu, or Gly
  SITE (302)..(302): Xaa at position 302 is Ala, Gly, or Pro
  SITE (305)..(305): Xaa at position 305 is Leu, Ala, Val, Gly, or Ile
  SITE (306)..(306): Xaa at position 306 is Leu, Ala, Val, Gly, or Ile
  SITE (309)..(309): Xaa at position 309 is Met, Ile, Leu, Val, Ala, or Gly
  SITE (313)..(313): Xaa at position 313 is Ala, Gly, or Pro
  SITE (319)..(319): Xaa at position 319 is Trp, Tyr, Phe, Met, His, Ile, Leu Val, Ala, or Gly
  SITE (329)..(329): Xaa at position 329 is Val, Ala, Gly, Leu, or Ile
  SITE (342)..(342): Xaa at position 342 is Val, Ala, Gly, Leu, or Ile
  SITE (344)..(344): Xaa at position 344 is Met, Ile, Leu, Val, Ala, or Gly
  SITE (346)..(346): Xaa at position 346 is Ile, Ala, Val, Leu, or Gly
  SITE (355)..(355): Xaa at position 355 is Ile, Ala, Val, Leu, or Gly
  SITE (358)..(358): Xaa at position 358 is Val, Ala, Gly, Leu, or Ile
  SITE (362)..(362): Xaa at position 362 is Leu, Ala, Val, Gly, or Ile
  SITE (372)..(372): Xaa at position 372 is Val, Ala, Gly, Leu, or Ile
  SITE (373)..(373): Xaa at position 373 is Ile, Ala, Val, Leu, or Gly
  SITE (374)..(374): Xaa at position 374 is Leu, Ala, Val, Gly, or Ile
  SITE (377)..(377): Xaa at position 377 is His, Phe, Tyr, Lys, Arg, Gly, Ser Thr, Ala, Val, Leu, Ile, Asn, Met, or Gln
  SITE (382)..(382): Xaa at position 382 is Val, Ala, Gly, Leu, or Ile
  SITE (383)..(383): Xaa at position 383 is Phe, Tyr, Met, His, Ile, Leu, Val Ala, or Gly
  SITE (386)..(386): Xaa at position 386 is Ile, Ala, Val, Leu, or Gly
  SITE (393)..(393): Xaa at position 393 is Ala, Gly, or Pro
  SITE (394)..(394): Xaa at position 394 is Val, Ala, Gly, Leu, or Ile
  SITE (396)..(396): Xaa at position 396 is His, Phe, Tyr, Lys, Arg, Gly, Ser Thr, Ala, Val, Leu, Ile, Asn, Met, or Gln
  SITE (398)..(398): Xaa at position 398 is Ile, Ala, Val, Leu, or Gly
  SITE (399)..(399): Xaa at position 399 is Val, Ala, Gly, Leu, or Ile
  SITE (402)..(402): Xaa at position 402 is Phe, Tyr, Met, His, Ile, Leu, Val Ala, or Gly
  SITE (405)..(405): Xaa at position 405 is Leu, Ala, Val, Gly, or Ile
  SITE (416)..(416): Xaa at position 416 is Ile, Ala, Val, Leu, or Gly
  SITE (417)..(417): Xaa at position 417 is Leu, Ala, Val, Gly, or Ile
  SITE (418)..(418): Xaa at position 418 is Phe, Tyr, Met, His, Ile, Leu, Val Ala, or Gly
  SITE (419)..(419): Xaa at position 419 is Ala, Gly, or Pro
  SITE (421)..(421): Xaa at position 421 is Trp, Tyr, Phe, Met, His, Ile, Leu Val, Ala, or Gly
  SITE (423)..(423): Xaa at position 423 is Ala, Gly, or Pro
  SITE (426)..(426): Xaa at position 426 is Phe, Tyr, Met, His, Ile, Leu, Val Ala, or Gly
  SITE (428)..(428): Xaa at position 428 is Leu, Ala, Val, Gly, or Ile
  SITE (429)..(429): Xaa at position 429 is Leu, Ala, Val, Gly, or Ile
  SITE (435)..(435): Xaa at position 435 is Ala, Gly, or Pro
  SITE (442)..(442): Xaa at position 442 is Leu, Ala, Val, Gly, or Ile
  SITE (447)..(447): Xaa at position 447 is Val, Ala, Gly, Leu, or Ile
  SITE (448)..(448): Xaa at position 448 is Ala, Gly, or Pro
  SITE (449)..(449): Xaa at position 449 is Tyr, Phe, Met, His, Ile, Leu, Val Ala, or Gly
  SITE (450)..(450): Xaa at position 450 is Ile, Ala, Val, Leu, or Gly
  SITE (452)..(452): Xaa at position 452 is Ala, Gly, or Pro
  SITE (456)..(456): Xaa at position 456 is Ile, Ala, Val, Leu, or Gly
  SITE (460)..(460): Xaa at position 460 is Tyr, Phe, Met, His, Ile, Leu, Val Ala, or Gly
  SITE (462)..(462): Xaa at position 462 is Leu, Ala, Val, Gly, or Ile
  SITE (464)..(464): Xaa at position 464 is Val, Ala, Gly, Leu, or Ile
  SITE (466)..(466): Xaa at position 466 is Cys, Ala, Val, Gly, Ser, or Thr
  SITE (469)..(469): Xaa at position 469 is Leu, Ala, Val, Gly, or Ile
  SITE (470)..(470): Xaa at position 470 is Met, Ile, Leu, Val, Ala, or Gly
  SITE (474)..(474): Xaa at position 474 is Val, Ala, Gly, Leu, or Ile
  SITE (477)..(477): Xaa at position 477 is Leu, Ala, Val, Gly, or Ile
  SITE (493)..(493): Xaa at position 493 is Leu, Ala, Val, Gly, or Ile
  SITE (497)..(497): Xaa at position 497 is Trp, Tyr, Phe, Met, His, Ile, Leu Val, Ala, or Gly
  SITE (515)..(515): Xaa at position 515 is Leu, Ala, Val, Gly, or Ile
  SITE (521)..(521): Xaa at position 521 is Phe, Tyr, Met, His, Ile, Leu, Val Ala, or Gly
  SITE (523)..(523): Xaa at position 523 is Val, Ala, Gly, Leu, or Ile
  SITE (524)..(524): Xaa at position 524 is Phe, Tyr, Met, His, Ile, Leu, Val Ala, or Gly
  SITE (525)..(525): Xaa at position 525 is Phe, Tyr, Met, His, Ile, Leu, Val Ala, or Gly
  SITE (530)..(530): Xaa at position 530 is Ile, Ala, Val, Leu, or Gly
  SITE (531)..(531): Xaa at position 531 is Ala, Gly, or Pro
  SITE (535)..(535): Xaa at position 535 is Ala, Gly, or Pro
  SITE (537)..(537): Xaa at position 537 is Tyr, Phe, Met, His, Ile, Leu, Val Ala, or Gly
  SITE (549)..(549): Xaa at position 549 is Tyr, Phe, Met, His, Ile, Leu, Val Ala, or Gly
  SITE (551)..(551): Xaa at position 551 is Leu, Ala, Val, Gly, or Ile
  SITE (553)..(553): Xaa at position 553 is His, Phe, Tyr, Lys, Arg, Gly, Ser Thr, Ala, Val, Leu, Ile, Asn, Met, or Gln
  SITE (555)..(555): Xaa at position 555 is Val, Ala, Gly, Leu, or Ile
  SITE (561)..(561): Xaa at position 561 is Leu, Ala, Val, Gly, or Ile
  SITE (562)..(562): Xaa at position 562 is Val, Ala, Gly, Leu, or Ile
  SITE (565)..(565): Xaa at position 565 is Phe, Tyr, Met, His, Ile, Leu, Val Ala, or Gly
  SITE (570)..(570): Xaa at position 570 is Phe, Tyr, Met, His, Ile, Leu, Val Ala, or Gly
  SITE (573)..(573): Xaa at position 573 is His, Phe, Tyr, Lys, Arg, Gly, Ser Thr, Ala, Val, Leu, Ile, Asn, Met, or Gln
  SITE (576)..(576): Xaa at position 576 is Val, Ala, Gly, Leu, or Ile
  SITE (577)..(577): Xaa at position 577 is Ala, Gly, or Pro
  SITE (579)..(579): Xaa at position 579 is Val, Ala, Gly, Leu, or Ile
  SITE (583)..(583): Xaa at position 583 is Met, Ile, Leu, Val, Ala, or Gly
  SITE (584)..(584): Xaa at position 584 is Val, Ala, Gly, Leu, or Ile
  SITE (587)..(587): Xaa at position 587 is Leu, Ala, Val, Gly, or Ile
  SITE (588)..(588): Xaa at position 588 is Ala, Gly, or Pro
  SITE (597)..(597): Xaa at position 597 is Cys, Ala, Val, Gly, Ser, or Thr
  SITE (600)..(600): Xaa at position 600 is Tyr, Phe, Met, His, Ile, Leu, Val Ala, or Gly
  SITE (601)..(601): Xaa at position 601 is Ala, Gly, or Pro
  SITE (603)..(603): Xaa at position 603 is Val, Ala, Gly, Leu, or Ile
  SITE (604)..(604): Xaa at position 604 is Leu, Ala, Val, Gly, or Ile
  SITE (607)..(607): Xaa at position 607 is Tyr, Phe, Met, His, Ile, Leu, Val Ala, or Gly
  SITE (608)..(608): Xaa at position 608 is Ala, Gly, or Pro
  SITE (611)..(611): Xaa at position 611 is Ile, Ala, Val, Leu, or Gly
  SITE (627)..(627): Xaa at position 627 is Val, Ala, Gly, Leu, or Ile
  SITE (632)..(632): Xaa at position 632 is Leu, Ala, Val, Gly, or Ile
  SITE (636)..(636): Xaa at position 636 is Val, Ala, Gly, Leu, or Ile
  SITE (639)..(639): Xaa at position 639 is Phe, Tyr, Met, His, Ile, Leu, Val Ala, or Gly
  SITE (643)..(643): Xaa at position 643 is Ala, Gly, or Pro
  SITE (646)..(646): Xaa at position 646 is Phe, Tyr, Met, His, Ile, Leu, Val Ala, or Gly
  SITE (661)..(661): Xaa at position 661 is Leu, Ala, Val, Gly, or Ile
  SITE (664)..(664): Xaa at position 664 is Met, Ile, Leu, Val, Ala, or Gly
  SITE (668)..(668): Xaa at position 668 is Leu, Ala, Val, Gly, or Ile
  SITE (669)..(669): Xaa at position 669 is Met, Ile, Leu, Val, Ala, or Gly
  SITE (671)..(671): Xaa at position 671 is Leu, Ala, Val, Gly, or Ile
  SITE (675)..(675): Xaa at position 675 is Phe, Tyr, Met, His, Ile, Leu, Val Ala, or Gly
  SITE (679)..(679): Xaa at position 679 is Leu, Ala, Val, Gly, or Ile
  SITE (686)..(686): Xaa at position 686 is Phe, Tyr, Met, His, Ile, Leu, Val Ala, or Gly
  SITE (687)..(687): Xaa at position 687 is Tyr, Phe, Met, His, Ile, Leu, Val Ala, or Gly
  SITE (689)..(689): Xaa at position 689 is His, Phe, Tyr, Lys, Arg, Gly, Ser Thr, Ala, Val, Leu, Ile, Asn, Met, or Gln
  SITE (691)..(691): Xaa at position 691 is Ile, Ala, Val, Leu, or Gly
  SITE (692)..(692): Xaa at position 692 is Tyr, Phe, Met, His, Ile, Leu, Val Ala, or Gly
  SITE (693)..(693): Xaa at position 693 is Ala, Gly, or Pro
  SITE (705)..(705): Xaa at position 705 is Phe, Tyr, Met, His, Ile, Leu, Val Ala, or Gly
  SITE (708)..(708): Xaa at position 708 is Ile, Ala, Val, Leu, or Gly
  SITE (712)..(712): Xaa at position 712 is Leu, Ala, Val, Gly, or Ile
  SITE (728)..(728): Xaa at position 728 is Val, Ala, Gly, Leu, or Ile
  SITE (732)..(732): Xaa at position 732 is Ile, Ala, Val, Leu, or Gly
  SITE (733)..(733): Xaa at position 733 is Tyr, Phe, Met, His, Ile, Leu, Val Ala, or Gly
  SITE (735)..(735): Xaa at position 735 is Ala, Gly, or Pro
  SITE (736)..(736): Xaa at position 736 is Ala, Gly, or Pro
  SITE (739)..(739): Xaa at position 739 is Val, Ala, Gly, Leu, or Ile
  SITE (742)..(742): Xaa at position 742 is Ala, Gly, or Pro
  SITE (743)..(743): Xaa at position 743 is Ala, Gly, or Pro
  SITE (746)..(746): Xaa at position 746 is Leu, Ala, Val, Gly, or Ile
MWNLLHETDSAVATARRPRWLCAGALVLAGGFFLLGFLFGWFIKSSNEATNITPKHNMKAXLDELKAENXKKFXYNXTQIPHXXGTEQNFQLXKQIQSQWKEFGLDSXEXAHXDXLXSYPNKTHPNYXSXINEDGNEIFNTSLFEPPPPGYENVSDIXPPXSXXSPQGMPEGDXXXXNYXRTEDFFKXERDMKINXSGKXXXXRYGKVFRGNKXKNXQLAGAKGXXXXSDPADXFXPGVKSYPDGWNLPGGGXQRGNXXNLNGXGDPXTPGYPXNEYAYRRGIAEAXGLPSIPXHPXGYYDXQKXXEKXGGSXPPDSSXRGSLKVPYNXGPGFTGNFSTQKXKXHXHSTNEVTRXYNXIGTXRGAVEPDRYXXXGGXRDSWXXGGXDPQSGAXXVXEXXRSXGTXKKEGWRPRRTXXXXSXDXEEXGXXGSTEWXEENSRLXQERGXXXXNXDSSXEGNXTXRXDXTPXXYSLXHNXTKELKSPDEGFEGKSXYESXTKKSPSPEFSGMPRISKXGSGNDXEXXXQRLGXXSGRXRXTKNWETNKFSGXPXYXSXYETYEXXEKXYDPMXKYXLTXXQXRGGXXFEXXNSIVLPFDXRDXXVXXRKXXDKXYSISMKHPQEMKTYSXSFDSXFSAXKNXTEIXSKXSERLQDFDKSNPIVXRMXNDQXXFXERAXIDPXGLPDRPXXRXVXXXPSSHNKYAGESXPGXYDAXFDIESKVDPSKAWGEXKRQXXVXXFTXQAXXETXSEVA

SEQ ID NO: 636 - protein, 1500 aa, Homo sapiens
  SITE (10)..(10): Xaa at position 10 is Val, Ala, Gly, Leu, or Ile
  SITE (12)..(12): Xaa at position 12 is Ile, Ala, Val, Leu, or Gly
  SITE (14)..(14): Xaa at position 14 is Val, Ala, Gly, Leu, or Ile
  SITE (17)..(17): Xaa at position 17 is Met, Ile, Leu, Val, Ala, or Gly
  SITE (22)..(22): Xaa at position 22 is Cys, Ala, Val, Gly, Ser, or Thr
  SITE (23)..(23): Xaa at position 23 is Val, Ala, Gly, Leu, or Ile
  SITE (26)..(26): Xaa at position 26 is Ile, Ala, Val, Leu, or Gly
  SITE (30)..(30): Xaa at position 30 is Ile, Ala, Val, Leu, or Gly
  SITE (48)..(48): Xaa at position 48 is Ala, Gly, or Pro
  SITE (50)..(50): Xaa at position 50 is Ile, Ala, Val, Leu, or Gly
  SITE (52)..(52): Xaa at position 52 is Tyr, Phe, Met, His, Ile, Leu, Val Ala, or Gly
  SITE (62)..(62): Xaa at position 62 is Leu, Ala, Val, Gly, or Ile
  SITE (66)..(66): Xaa at position 66 is Ile, Ala, Val, Leu, or Gly
  SITE (173)..(173): Xaa at position 173 is Leu, Ala, Val, Gly, or Ile
  SITE (175)..(175): Xaa at position 175 is Met, Ile, Leu, Val, Ala, or Gly
  SITE (177)..(177): Xaa at position 177 is Val, Ala, Gly, Leu, or Ile
  SITE (189)..(189): Xaa at position 189 is Ile, Ala, Val, Leu, or Gly
  SITE (193)..(193): Xaa at position 193 is Ile, Ala, Val, Leu, or Gly
  SITE (211)..(211): Xaa at position 211 is Ala, Gly, or Pro
  SITE (213)..(213): Xaa at position 213 is Ile, Ala, Val, Leu, or Gly
  SITE (215)..(215): Xaa at position 215 is Tyr, Phe, Met, His, Ile, Leu, Val Ala, or Gly
  SITE (222)..(222): Xaa at position 222 is Val, Ala, Gly, Leu, or Ile
  SITE (225)..(225): Xaa at position 225 is Met, Ile, Leu, Val, Ala, or Gly
  SITE (229)..(229): Xaa at position 229 is Ile, Ala, Val, Leu, or Gly
  SITE (234)..(234): Xaa at position 234 is Phe, Tyr, Met, His, Ile, Leu, Val Ala, or Gly
  SITE (281)..(281): Xaa at position 281 is Phe, Tyr, Met, His, Ile, Leu, Val Ala, or Gly
  SITE (283)..(283): Xaa at position 283 is Ile, Ala, Val, Leu, or Gly
  SITE (292)..(292): Xaa at position 292 is Val, Ala, Gly, Leu, or Ile
  SITE (295)..(295): Xaa at position 295 is Ile, Ala, Val, Leu, or Gly
  SITE (299)..(299): Xaa at position 299 is Leu, Ala, Val, Gly, or Ile
  SITE (317)..(317): Xaa at position 317 is Ala, Gly, or Pro
  SITE (319)..(319): Xaa at position 319 is Val, Ala, Gly, Leu, or Ile
  SITE (331)..(331): Xaa at position 331 is Leu, Ala, Val, Gly, or Ile
  SITE (335)..(335): Xaa at position 335 is Ile, Ala, Val, Leu, or Gly
  SITE (381)..(381): Xaa at position 381 is Ile, Ala, Val, Leu, or Gly
  SITE (383)..(383): Xaa at position 383 is Ile, Ala, Val, Leu, or Gly
  SITE (386)..(386): Xaa at position 386 is Met, Ile, Leu, Val, Ala, or Gly
  SITE (391)..(391): Xaa at position 391 is Cys, Ala, Val, Gly, Ser, or Thr
  SITE (392)..(392): Xaa at position 392 is Val, Ala, Gly, Leu, or Ile
  SITE (395)..(395): Xaa at position 395 is Ile, Ala, Val, Leu, or Gly
  SITE (399)..(399): Xaa at position 399 is Ile, Ala, Val, Leu, or Gly
  SITE (419)..(419): Xaa at position 419 is Val, Ala, Gly, Leu, or Ile
  SITE (421)..(421): Xaa at position 421 is Tyr, Phe, Met, His, Ile, Leu, Val Ala, or Gly
  SITE (431)..(431): Xaa at position 431 is Leu, Ala, Val, Gly, or Ile
  SITE (435)..(435): Xaa at position 435 is Ile, Ala, Val, Leu, or Gly
  SITE (490)..(490): Xaa at position 490 is Cys, Ala, Val, Gly, Ser, or Thr
  SITE (492)..(492): Xaa at position 492 is Ile, Ala, Val, Leu, or Gly
  SITE (503)..(503): Xaa at position 503 is Val, Ala, Gly, Leu, or Ile
  SITE (506)..(506): Xaa at position 506 is Ile, Ala, Val, Leu, or Gly
  SITE (510)..(510): Xaa at position 510 is Leu, Ala, Val, Gly, or Ile
  SITE (516)..(516): Xaa at position 516 is Ile, Ala, Val, Leu, or Gly
  SITE (520)..(520): Xaa at position 520 is Leu, Ala, Val, Gly, or Ile
  SITE (528)..(528): Xaa at position 528 is Ala, Gly, or Pro
  SITE (530)..(530): Xaa at position 530 is Val, Ala, Gly, Leu, or Ile
  SITE (532)..(532): Xaa at position 532 is Tyr, Phe, Met, His, Ile, Leu, Val Ala, or Gly
  SITE (542)..(542): Xaa at position 542 is Ile, Ala, Val, Leu, or Gly
  SITE (546)..(546): Xaa at position 546 is Ile, Ala, Val, Leu, or Gly
  SITE (566)..(566): Xaa at position 566 is Leu, Ala, Val, Gly, or Ile
  SITE (568)..(568): Xaa at position 568 is Leu, Ala, Val, Gly, or Ile
  SITE (570)..(570): Xaa at position 570 is Val, Ala, Gly, Leu, or Ile
  SITE (582)..(582): Xaa at position 582 is Ile, Ala, Val, Leu, or Gly
  SITE (586)..(586): Xaa at position 586 is Leu, Ala, Val, Gly, or Ile
  SITE (595)..(595): Xaa at position 595 is Cys, Ala, Val, Gly, Ser, or Thr
  SITE (604)..(604): Xaa at position 604 is Ala, Gly, or Pro
  SITE (606)..(606): Xaa at position 606 is Ile, Ala, Val, Leu, or Gly
  SITE (608)..(608): Xaa at position 608 is Tyr, Phe, Met, His, Ile, Leu, Val Ala, or Gly
  SITE (618)..(618): Xaa at position 618 is Ile, Ala, Val, Leu, or Gly
  SITE (619)..(619): Xaa at position 619 is Ile, Ala, Val, Leu, or Gly
  SITE (622)..(622): Xaa at position 622 is Ile, Ala, Val, Leu, or Gly
  SITE (629)..(629): Xaa at position 629 is Ala, Gly, or Pro
  SITE (837)..(837): Xaa at position 837 is Val, Ala, Gly, Leu, or Ile
MDPSMGVNSXTXSXEGXTCNSXXWTXEQQXGKVNGVHHIKVSLEEKNXTXIXDPKLQTPKTXQEAXDDMGFDAVIHNPDPLPVLTDTLFLTVTASLTLPWDHIQSTLLKTKGVTDIKIYPQKRTVAVTIIPSIVNANQIKELVPELSLDTGTLEKKSGACEDHSMAQAGEVVXKXKXEGMTCHSCTSTXEGKXGKLQGVQRIKVSLDNQEXTXVXQPHLISXEEXKKQXEAMGXPAFVKKQPKYLKLGAIDVERLKNTPVKSSEGSQQRSPSYTNDSTATXIXDGMHCKSCXSNXESTXSALQYVSSIVVSLENRSXIXKYNASSVTPESXRKAXEAVSPGLYRVSITSEVESTSNSPSSSSLQKIPLNVVSQPLTQETVXNXDGXTCNSXXQSXEGVXSKKPGVKSIRVSLANSNGTXEXDPLLTSPETXRGAXEDMGFDATLSDTNEPLVVIAQPSSEMPLLTSTNEFYTKGMTPVQDKEEGKNSSKXYXQVTGMTCASCXANXERNXRREEGXYSIXVALMAGKXEXRXNPAVIQPPMXAEFXRELGFGATVIENADEGDGVXEXVXRGMTCASCVHKXESSXTKHRGILYXSVALATNKXHXKXDPEIIGPRDXXHTXESLGFEXSLVKKDRSASHLDHKREIRQWRRSFLVSLFFCIPVMGLMIYMMVMDHHFATLHHNQNMSKEEMINLHSSMFLERQILPGLSVMNLLSFLLCVPVQFFGGWYFYIQAYKALKHKTANMDVLIVLATTIAFAYSLIILLVAMYERAKVNPITFFDTPPMLFVFIALGRWLEHIAKGKTSEALAKLISLQATEATIVTLDSDNILLSEEQXDVELVQRGDIIKVVPGGKFPVDGRVIEGHSMVDESLITGEAMPVAKKPGSTVIAGSINQNGSLLICATHVGADTTLSQIVKLVEEAQTSKAPIQQFADKLSGYFVPFIVFVSIATLLVWIVIGFLNFEIVETYFPGYNRSISRTETIIRFAFQASITVLCIACPCSLGLATPTAVMVGTGVGAQNGILIKGGEPLEMAHKVKVVVFDKTGTITHGTPVVNQVKVLTESNRISHHKILAIVGTAESNSEHPLGTAITKYCKQELDTETLGTCIDFQVVPGCGISCKVTNIEGLLHKNNWNIEDNNIKNASLVQIDASNEQSSTSSSMIIDAQISNALNAQQYKVLIGNREWMIRNGLVINNDVNDFMTEHERKGRTAVLVAVDDELCGLIAIADTVKPEAELAIHILKSMGLEVVLMTGDNSKTARSIASQVGITKVFAEVLPSHKVAKVKQLQEEGKRVAMVGDGINDSPALAMANVGIAIGTGTDVAIEAADVVLIRNDLLDVVASIDLSRETVKRIRINFVFALIYNLVGIPIAAGVFMPIGLVLQPWMGSAAMAASSVSVVLSSLFLKLYRKPTYESYELPARSQIGQKSPSEISVHVGIDDTSRNSPKLGLLDRIVNYSRASINSLLSDKRSLNSVVTSEPDKHSLLVGDFREDDDTAL

SEQ ID NO: 637 - protein, 2471 aa, Homo sapiens
  SITE (315)..(315): Xaa at position 315 is Cys, Ala, Val, Gly, Ser, or Thr
  SITE (491)..(491): Xaa at position 491 is Cys, Ala, Val, Gly, Ser, or Thr
  SITE (642)..(642): Xaa at position 642 is Cys, Ala, Val, Gly, Ser, or Thr
  SITE (1184)..(1184): Xaa at position 1184 is Cys, Ala, Val, Gly, Ser, or Thr
  SITE (1443)..(1443): Xaa at position 1443 is Cys, Ala, Val, Gly, Ser, or Thr
  SITE (1455)..(1455): Xaa at position 1455 is Cys, Ala, Val, Gly, Ser, or Thr
  SITE (1484)..(1484): Xaa at position 1484 is Cys, Ala, Val, Gly, Ser, or Thr
  SITE (1490)..(1490): Xaa at position 1490 is Leu, Ala, Val, Gly, or Ile
  SITE (1509)..(1509): Xaa at position 1509 is Cys, Ala, Val, Gly, Ser, or Thr
  SITE (1522)..(1522): Xaa at position 1522 is Cys, Ala, Val, Gly, Ser, or Thr
  SITE (1529)..(1529): Xaa at position 1529 is Trp, Tyr, Phe, Met, His, Ile Leu, Val, Ala, or Gly
  SITE (1547)..(1547): Xaa at position 1547 is Leu, Ala, Val, Gly, or Ile
  SITE (1549)..(1549): Xaa at position 1549 is Ile, Ala, Val, Leu, or Gly
  SITE (1551)..(1551): Xaa at position 1551 is Val, Ala, Gly, Leu, or Ile
  SITE (1558)..(1558): Xaa at position 1558 is Leu, Ala, Val, Gly, or Ile
  SITE (1565)..(1565): Xaa at position 1565 is Phe, Tyr, Met, His, Ile, Leu Val, Ala, or Gly
  SITE (1573)..(1573): Xaa at position 1573 is Leu, Ala, Val, Gly, or Ile
  SITE (1623)..(1623): Xaa at position 1623 is Val, Ala, Gly, Leu, or Ile
  SITE (1625)..(1625): Xaa at position 1625 is Leu, Ala, Val, Gly, or Ile
  SITE (1627)..(1627): Xaa at position 1627 is Ile, Ala, Val, Leu, or Gly
  SITE (1632)..(1632): Xaa at position 1632 is Cys, Ala, Val, Gly, Ser, or Thr
  SITE (1640)..(1640): Xaa at position 1640 is Phe, Tyr, Met, His, Ile, Leu Val, Ala, or Gly
  SITE (1646)..(1646): Xaa at position 1646 is Ala, Gly, or Pro
  SITE (1647)..(1647): Xaa at position 1647 is Ala, Gly, or Pro
  SITE (1649)..(1649): Xaa at position 1649 is Leu, Ala, Val, Gly, or Ile
  SITE (1650)..(1650): Xaa at position 1650 is Leu, Ala, Val, Gly, or Ile
  SITE (1651)..(1651): Xaa at position 1651 is Ala, Gly, or Pro
MPALRPALLWALLALWLCCAAPAHALQCRDGYEPCVNEGMCVTYHNGTGYCKCPEGFLGEYCQHRDPCEKNRCQNGGTCVAQAMLGKATCRCASGFTGEDCQYSTSHPCFVSRPCLNGGTCHMLSRDTYECTCQVGFTGKECQWTDACLSHPCANGSTCTTVANQFSCKCLTGFTGQKCETDVNECDIPGHCQHGGTCLNLPGSYQCQCPQGFTGQYCDSLYVPCAPSPCVNGGTCRQTGDFTFECNCLPGFEGSTCERNIDDCPNHRCQNGGVCVDGVNTYNCRCPPQWTGQFCTEDVDECLLQPNACQNGGTXANRNGGYGCVCVNGWSGDDCSENIDDCAFASCTPGSTCIDRVASFSCMCPEGKAGLLCHLDDACISNPCHKGALCDTNPLNGQYICTCPQGYKGADCTEDVDECAMANSNPCEHAGKCVNTDGAFHCECLKGYAGPRCEMDINECHSDPCQNDATCLDKIGGFTCLCMPGFKGVHXELEINECQSNPCVNNGQCVDKVNRFQCLCPPGFTGPVCQIDIDDCSSTPCLNGAKCIDHPNGYECQCATGFTGVLCEENIDNCDPDPCHHGQCQDGIDSYTCICNPGYMGAICSDQIDECYSSPCLNDGRCIDLVNGYQCNCQPGTSGVNXEINFDDCASNPCIHGICMDGINRYSCVCSPGFTGQRCNIDIDECASNPCRKGATCINGVNGFRCICPEGPHHPSCYSQVNECLSNPCIHGNCTGGLSGYKCLCDAGWVGINCEVDKNECLSNPCQNGGTCDNLVNGYRCTCKKGFKGYNCQVNIDECASNPCLNQGTCFDDISGYTCHCVLPYTGKNCQTVLAPCSPNPCENAAVCKESPNFESYTCLCAPGWQGQRCTIDIDECISKPCMNHGLCHNTQGSYMCECPPGFSGMDCEEDIDDCLANPCQNGGSCMDGVNTFSCLCLPGFTGDKCQTDMNECLSEPCKNGGTCSDYVNSYTCKCQAGFDGVHCENNINECTESSCFNGGTCVDGINSFSCLCPVGFTGSFCLHEINECSSHPCLNEGTCVDGLGTYRCSCPLGYTGKNCQTLVNLCSRSPCKNKGTCVQKKAESQCLCPSGWAGAYCDVPNVSCDIAASRRGVLVEHLCQHSGVCINAGNTHYCQCPLGYTGSYCEEQLDECASNPCQHGATCSDFIGGYRCECVPGYQGVNXEYEVDECQNQPCQNGGTCIDLVNHFKCSCPPGTRGLLCEENIDDCARGPHCLNGGQCMDRIGGYSCRCLPGFAGERCEGDINECLSNPCSSEGSLDCIQLTNDYLCVCRSAFTGRHCETFVDVCPQMPCLNGGTCAVASNMPDGFICRCPPGFSGARCQSSCGQVKCRKGEQCVHTASGPRCFCPSPRDCESGCASSPCQHGGSCHPQRQPPYYSCQCAPPFSGSRCELYTAPPSTPPATCLSQYCADKARDGVCDEAXNSHACQWDGGDXSLTMENPWANCSSPLPCWDYINNQCDELXNTVECXFDNFECQGNSKTCKYDKYXADHFKDNHCDQGXNSEECGXDGLDCAADQPENLAEGTXVXVXLMPPEQXLQDARSXLRALGTLXHTNLRIKRDSQGELMVYPYYGEKSAAMKKQRMTRRSLPGEQEQEVAGSKXFXEXDNRQXVQDSDHCXKNTDAXXAXXXSHAIQGTLSYPLVSVVSESLTPERTQLLYLLAVAVVIILFIILLGVIMAKRKRKHGSLWLPEGFTLRRDASNHKRREPVGQDAVGLKNLSVQVSEANLIGTGTSEHWVDDEGPQPKKVKAEDEALLSEEDDPIDRRPWTQQHLEAADIRRTPSLALTPPQAEQEVDVLDVNVRGPDGCTPLMLASLRGGSSDLSDEDEDAEDSSANIITDLVYQGASLQAQTDRTGEMALHLAARYSRADAAKRLLDAGADANAQDNMGRCPLHAAVAADAQGVFQILIRNRVTDLDARMNDGTTPLILAARLAVEGMVAELINCQADVNAVDDHGKSALHWAAAVNNVEATLLLLKNGANRDMQDNKEETPLFLAAREGSYEAAKILLDHFANRDITDHMDRLPRDVARDRMHHDIVRLLDEYNVTPSPPGTVLTSALSPVICGPNRSFLSLKHTPMGKKSRRPSAKSTMPTSLPNLAKEAKDAKGSRRKKSLSEKVQLSESSVTLSPVDSLESPHTYVSDTTSSPMITSPGILQASPNPMLATAAPPAPVHAQHALSFSNLHEMQPLAHGASTVLPSVSQLLSHHHIVSPGSGSAGSLSRLHPVPVPADWMNRMEVNETQYNEMFGMVLAPAEGTHPGIAPQSRPPEGKHITTPREPLPPIVTFQLIPKGSIAQPAGAPQPQSTCPPAVAGPLPTMYQIPEMARLPSVAFPTAMMPQQDGQVAQTILPAYHPFPASVGKYPTPPSQHSYASSNAAERTPSHSGHLQGEHPYLTPSPESPDQWSSSSPHSASDWSDVTTSPTPGGAGGGQRGPGTHMSEPPHNNMQVYA

SEQ ID NO: 638 - protein, 509 aa, Homo sapiens
  SITE (402)..(402): Xaa at position 402 is Val, Ala, Gly, Leu, or Ile
  SITE (411)..(411): Xaa at position 411 is Leu, Ala, Val, Gly, or Ile
  SITE (424)..(424): Xaa at position 424 is Val, Ala, Gly, Leu, or Ile
  SITE (447)..(447): Xaa at position 447 is Val, Ala, Gly, Leu, or Ile
  SITE (470)..(470): Xaa at position 470 is Leu, Ala, Val, Gly, or Ile
  SITE (473)..(473): Xaa at position 473 is Leu, Ala, Val, Gly, or Ile
  SITE (478)..(478): Xaa at position 478 is Trp, Tyr, Phe, Met, His, Ile, Leu Val, Ala, or Gly
  SITE (489)..(489): Xaa at position 489 is Leu, Ala, Val, Gly, or Ile
  SITE (495)..(495): Xaa at position 495 is Leu, Ala, Val, Gly, or Ile
  SITE (498)..(498): Xaa at position 498 is Ile, Ala, Val, Leu, or Gly
MVDGVMILPVLIMIALPSPSMEDEKPKVNPKLYMCVCEGLSCGNEDHCEGQQCFSSLSINDGFHVYQKGCFQVYEQGKMTCKTPPSPGQAVECCQGDWCNRNITAQLPTKGKSFPGTQNFHLEVGLIILSVVFAVCLLACLLGVALRKFKRRNQERLNPRDVEYGTIEGLITTNVGDSTLADLLDHSCTSGSGSGLPFLVQRTVARQITLLECVGKGRYGEVWRGSWQGENVAVKIFSSRDEKSWFRETELYNTVMLRHENILGFIASDMTSRHSSTQLWLITHYHEMGSLYDYLQLTTLDTVSCLRIVLSIASGLAHLHIEIFGTQGKPAIAHRDLKSKNILVKKNGQCCIADLGLAVMHSQSTNQLDVGNNPRVGTKRYMAPEVLDETIQVDCFDSYKRXDIWAFGLVXWEVARRMVSNGIXEDYKPPFYDVVPNDPSFEDMRKXVCVDQQRPNIPNRWFSDPTLTSXAKXMKECXYQNPSARLTAXRIKKTXTKXDNSLDKLKTDC

SEQ ID NO: 639 - protein, 493 aa, Homo sapiens
  SITE (49)..(49): Xaa at position 49 is Val, Ala, Gly, Leu, or Ile
  SITE (51)..(51): Xaa at position 51 is Ile, Ala, Val, Leu, or Gly
  SITE (53)..(53): Xaa at position 53 is Leu, Ala, Val, Gly, or Ile
  SITE (55)..(55): Xaa at position 55 is Val, Ala, Gly, Leu, or Ile
  SITE (61)..(61): Xaa at position 61 is Ile, Ala, Val, Leu, or Gly
  SITE (74)..(74): Xaa at position 74 is Val, Ala, Gly, Leu, or Ile
  SITE (76)..(76): Xaa at position 76 is Ile, Ala, Val, Leu, or Gly
  SITE (78)..(78): Xaa at position 78 is Ile, Ala, Val, Leu, or Gly
  SITE (80)..(80): Xaa at position 80 is Trp, Tyr, Phe, Met, His, Ile, Leu Val, Ala, or Gly
  SITE (105)..(105): Xaa at position 105 is Val, Ala, Gly, Leu, or Ile
  SITE (106)..(106): Xaa at position 106 is Trp, Tyr, Phe, Met, His, Ile, Leu Val, Ala, or Gly
  SITE (111)..(111): Xaa at position 111 is Val, Ala, Gly, Leu, or Ile
  SITE (112)..(112): Xaa at position 112 is Leu, Ala, Val, Gly, or Ile
  SITE (123)..(123): Xaa at position 123 is Ala, Gly, or Pro
  SITE (128)..(128): Xaa at position 128 is Val, Ala, Gly, Leu, or Ile
  SITE (130)..(130): Xaa at position 130 is Val, Ala, Gly, Leu, or Ile
  SITE (136)..(136): Xaa at position 136 is Val, Ala, Gly, Leu, or Ile
  SITE (138)..(138): Xaa at position 138 is Trp, Tyr, Phe, Met, His, Ile, Leu Val, Ala, or Gly
  SITE (142)..(142): Xaa at position 142 is Ala, Gly, or Pro
  SITE (148)..(148): Xaa at position 148 is Cys, Ala, Val, Gly, Ser, or Thr
  SITE (150)..(150): Xaa at position 150 is Val, Ala, Gly, Leu, or Ile
  SITE (159)..(159): Xaa at position 159 is Trp, Tyr, Phe, Met, His, Ile, Leu Val, Ala, or Gly
  SITE (166)..(166): Xaa at position 166 is Phe, Tyr, Met, His, Ile, Leu, Val Ala, or Gly
  SITE (176)..(176): Xaa at position 176 is Val, Ala, Gly, Leu, or Ile
  SITE (178)..(178): Xaa at position 178 is Phe, Tyr, Met, His, Ile, Leu, Val Ala, or Gly
  SITE (230)..(230): Xaa at position 230 is Val, Ala, Gly, Leu, or Ile
MARAPLGVLLLLGLLGRGVGKNEELRLYHHLFNNYDPGSRPVREPEDTXTXSXKXTLTNLXSLNEKEETLTTSXWXGXDXQDYRLNYSKDDFGGIETLRVPSELXXLPEIXXENNIDGQFGVXYDANXLXYEGGSXTXLPPXIYRSVXAXEVTYFPFDXQNCSLIXRSQTYNAEEXEXTFAVDNDGKTINKIDIDTEAYTENGEWAIDFCPGVIRRHHGGATDGPGETDXIYSLIIRRKPLFYVINIIVPCVLISGLVLLAYFLPAQAGGQKCTVSINVLLAQTVFLFLIAQKIPETSLSVPLLGRFLIFVMVVATLIVMNCVIVLNVSQRTPTTHAMSPRLRHVLLELLPRLLGSPPPPEAPRAASPPRRASSVGLLLRAEELILKKPRSELVFEGQRHRQGTWTAAFCQSLGAAAPEVRCCVDAVNFVAESTRDQEATGEEVSDWVRMGNALDNICFWAALVLFSVGSSLIFLGAYFNRVPDLPYAPCIQP

SEQ ID NO: 640 - protein, 1052 aa, Homo sapiens
  SITE (39)..(39): Xaa at position 39 is Val, Ala, Gly, Leu, or Ile
  SITE (58)..(58): Xaa at position 58 is His, Phe, Tyr, Lys, Arg, Gly, Ser Thr, Ala, Val, Leu, Ile, Asn, Met, or Gln
  SITE (64)..(64): Xaa at position 64 is Val, Ala, Gly, Leu, or Ile
  SITE (67)..(67): Xaa at position 67 is Ile, Ala, Val, Leu, or Gly
  SITE (68)..(68): Xaa at position 68 is Ile, Ala, Val, Leu, or Gly
  SITE (72)..(72): Xaa at position 72 is Val, Ala, Gly, Leu, or Ile
  SITE (82)..(82): Xaa at position 82 is Cys, Ala, Val, Gly, Ser, or Thr
  SITE (87)..(87): Xaa at position 87 is Leu, Ala, Val, Gly, or Ile
  SITE (124)..(124): Xaa at position 124 is Leu, Ala, Val, Gly, or Ile
  SITE (128)..(128): Xaa at position 128 is Tyr, Phe, Met, His, Ile, Leu, Val Ala, or Gly
  SITE (137)..(137): Xaa at position 137 is Phe, Tyr, Met, His, Ile, Leu, Val Ala, or Gly
  SITE (146)..(146): Xaa at position 146 is Phe, Tyr, Met, His, Ile, Leu, Val Ala, or Gly
  SITE (147)..(147): Xaa at position 147 is Phe, Tyr, Met, His, Ile, Leu, Val Ala, or Gly
  SITE (148)..(148): Xaa at position 148 is Tyr, Phe, Met, His, Ile, Leu, Val Ala, or Gly
  SITE (160)..(160): Xaa at position 160 is Ala, Gly, or Pro
  SITE (168)..(168): Xaa at position 168 is Ala, Gly, or Pro
  SITE (171)..(171): Xaa at position 171 is Leu, Ala, Val, Gly, or Ile
  SITE (173)..(173): Xaa at position 173 is Cys, Ala, Val, Gly, Ser, or Thr
  SITE (174)..(174): Xaa at position 174 is Leu, Ala, Val, Gly, or Ile
  SITE (188)..(188): Xaa at position 188 is Leu, Ala, Val, Gly, or Ile
  SITE (194)..(194): Xaa at position 194 is Tyr, Phe, Met, His, Ile, Leu, Val Ala, or Gly
  SITE (203)..(203): Xaa at position 203 is Leu, Ala, Val, Gly, or Ile
  SITE (207)..(207): Xaa at position 207 is Phe, Tyr, Met, His, Ile, Leu, Val Ala, or Gly
  SITE (217)..(217): Xaa at position 217 is Ala, Gly, or Pro
  SITE (228)..(228): Xaa at position 228 is Phe, Tyr, Met, His, Ile, Leu, Val Ala, or Gly
  SITE (241)..(241): Xaa at position 241 is Leu, Ala, Val, Gly, or Ile
  SITE (243)..(243): Xaa at position 243 is Phe, Tyr, Met, His, Ile, Leu, Val Ala, or Gly
  SITE (244)..(244): Xaa at position 244 is Phe, Tyr, Met, His, Ile, Leu, Val Ala, or Gly
  SITE (247)..(247): Xaa at position 247 is Leu, Ala, Val, Gly, or Ile
  SITE (258)..(258): Xaa at position 258 is Phe, Tyr, Met, His, Ile, Leu, Val Ala, or Gly
  SITE (272)..(272): Xaa at position 272 is Leu, Ala, Val, Gly, or Ile
  SITE (273)..(273): Xaa at position 273 is Ala, Gly, or Pro
  SITE (274)..(274): Xaa at position 274 is Ile, Ala, Val, Leu, or Gly
  SITE (280)..(280): Xaa at position 280 is Ile, Ala, Val, Leu, or Gly
  SITE (294)..(294): Xaa at position 294 is Ala, Gly, or Pro
  SITE (302)..(302): Xaa at position 302 is Ile, Ala, Val, Leu, or Gly
  SITE (316)..(316): Xaa at position 316 is Leu, Ala, Val, Gly, or Ile
  SITE (318)..(318): Xaa at position 318 is Leu, Ala, Val, Gly, or Ile
  SITE (323)..(323): Xaa at position 323 is Ala, Gly, or Pro
  SITE (329)..(329): Xaa at position 329 is Val, Ala, Gly, Leu, or Ile
  SITE (331)..(331): Xaa at position 331 is Ala, Gly, or Pro
  SITE (337)..(337): Xaa at position 337 is Ala, Gly, or Pro
  SITE (340)..(340): Xaa at position 340 is Met, Ile, Leu, Val, Ala, or Gly
  SITE (341)..(341): Xaa at position 341 is Ala, Gly, or Pro
  SITE (343)..(343): Xaa at position 343 is Leu, Ala, Val, Gly, or Ile
  SITE (344)..(344): Xaa at position 344 is Ile, Ala, Val, Leu, or Gly
  SITE (348)..(348): Xaa at position 348 is Cys, Ala, Val, Gly, Ser, or Thr
  SITE (369)..(369): Xaa at position 369 is Ala, Gly, or Pro
  SITE (373)..(373): Xaa at position 373 is Ile, Ala, Val, Leu, or Gly
  SITE (436)..(436): Xaa at position 436 is Val, Ala, Gly, Leu, or Ile
  SITE (451)..(451): Xaa at position 451 is Val, Ala, Gly, Leu, or Ile
  SITE (452)..(452): Xaa at position 452 is Ala, Gly, or Pro
  SITE (453)..(453): Xaa at position 453 is Ile, Ala, Val, Leu, or Gly
  SITE (459)..(459): Xaa at position 459 is Cys, Ala, Val, Gly, Ser, or Thr
  SITE (468)..(468): Xaa at position 468 is Phe, Tyr, Met, His, Ile, Leu, Val Ala, or Gly
  SITE (472)..(472): Xaa at position 472 is Ala, Gly, or Pro
  SITE (475)..(475): Xaa at position 475 is Met, Ile, Leu, Val, Ala, or Gly
  SITE (483)..(483): Xaa at position 483 is Ile, Ala, Val, Leu, or Gly
  SITE (489)..(489): Xaa at position 489 is Val, Ala, Gly, Leu, or Ile
  SITE (490)..(490): Xaa at position 490 is Ile, Ala, Val, Leu, or Gly
  SITE (495)..(495): Xaa at position 495 is Val, Ala, Gly, Leu, or Ile
  SITE (497)..(497): Xaa at position 497 is Ile, Ala, Val, Leu, or Gly
  SITE (498)..(498): Xaa at position 498 is Ile, Ala, Val, Leu, or Gly
  SITE (499)..(499): Xaa at position 499 is Met, Ile, Leu, Val, Ala, or Gly
  SITE (502)..(502): Xaa at position 502 is Cys, Ala, Val, Gly, Ser, or Thr
  SITE (507)..(507): Xaa at position 507 is Leu, Ala, Val, Gly, or Ile
  SITE (511)..(511): Xaa at position 511 is Leu, Ala, Val, Gly, or Ile
  SITE (524)..(524): Xaa at position 524 is Ile, Ala, Val, Leu, or Gly
  SITE (526)..(526): Xaa at position 526 is Tyr, Phe, Met, His, Ile, Leu, Val Ala, or Gly
  SITE (527)..(527): Xaa at position 527 is Ala, Gly, or Pro
  SITE (530)..(530): Xaa at position 530 is Leu, Ala, Val, Gly, or Ile
  SITE (533)..(533): Xaa at position 533 is Ala, Gly, or Pro
  SITE (534)..(534): Xaa at position 534 is Leu, Ala, Val, Gly, or Ile
  SITE (537)..(537): Xaa at position 537 is Leu, Ala, Val, Gly, or Ile
  SITE (547)..(547): Xaa at position 547 is Ile, Ala, Val, Leu, or Gly
  SITE (548)..(548): Xaa at position 548 is Ala, Gly, or Pro
  SITE (549)..(549): Xaa at position 549 is Ala, Gly, or Pro
  SITE (552)..(552): Xaa at position 552 is Val, Ala, Gly, Leu, or Ile
  SITE (553)..(553): Xaa at position 553 is Leu, Ala, Val, Gly, or Ile
  SITE (554)..(554): Xaa at position 554 is Val, Ala, Gly, Leu, or Ile
  SITE (560)..(560): Xaa at position 560 is Val, Ala, Gly, Leu, or Ile
  SITE (562)..(562): Xaa at position 562 is Leu, Ala, Val, Gly, or Ile
  SITE (565)..(565): Xaa at position 565 is Phe, Tyr, Met, His, Ile, Leu, Val Ala, or Gly
  SITE (567)..(567): Xaa at position 567 is Leu, Ala, Val, Gly, or Ile
  SITE (579)..(579): Xaa at position 579 is Ala, Gly, or Pro
  SITE (589)..(589): Xaa at position 589 is Met, Ile, Leu, Val, Ala, or Gly
  SITE (590)..(590): Xaa at position 590 is Ala, Gly, or Pro
  SITE (605)..(605): Xaa at position 605 is Val, Ala, Gly, Leu, or Ile
  SITE (607)..(607): Xaa at position 607 is Met, Ile, Leu, Val, Ala, or Gly
  SITE (608)..(608): Xaa at position 608 is Phe, Tyr, Met, His, Ile, Leu, Val Ala, or Gly
  SITE (611)..(611): Xaa at position 611 is Cys, Ala, Val, Gly, Ser, or Thr
  SITE (612)..(612): Xaa at position 612 is Met, Ile, Leu, Val, Ala, or Gly
  SITE (615)..(615): Xaa at position 615 is Ile, Ala, Val, Leu, or Gly
  SITE (631)..(631): Xaa at position 631 is Val, Ala, Gly, Leu, or Ile
  SITE (635)..(635): Xaa at position 635 is Ile, Ala, Val, Leu, or Gly
  SITE (651)..(651): Xaa at position 651 is Leu, Ala, Val, Gly, or Ile
  SITE (654)..(654): Xaa at position 654 is Leu, Ala, Val, Gly, or Ile
  SITE (655)..(655): Xaa at position 655 is Met, Ile, Leu, Val, Ala, or Gly
  SITE (658)..(658): Xaa at position 658 is Cys, Ala, Val, Gly, Ser, or Thr
  SITE (659)..(659): Xaa at position 659 is Trp, Tyr, Phe, Met, His, Ile, Leu Val, Ala, or Gly
  SITE (669)..(669): Xaa at position 669 is Phe, Tyr, Met, His, Ile, Leu, Val Ala, or Gly
  SITE (672)..(672): Xaa at position 672 is Leu, Ala, Val, Gly, or Ile
  SITE (676)..(676): Xaa at position 676 is Leu, Ala, Val, Gly, or Ile
  SITE (928)..(928): Xaa at position 928 is Val, Ala, Gly, Leu, or Ile
  SITE (931)..(931): Xaa at position 931 is Leu, Ala, Val, Gly, or Ile
  SITE (932)..(932): Xaa at position 932 is Val, Ala, Gly, Leu, or Ile
  SITE (938)..(938): Xaa at position 938 is Met, Ile, Leu, Val, Ala, or Gly
  SITE (942)..(942): Xaa at position 942 is Ile, Ala, Val, Leu, or Gly
  SITE (950)..(950): Xaa at position 950 is Tyr, Phe, Met, His, Ile, Leu, Val Ala, or Gly
  SITE (957)..(957): Xaa at position 957 is Val, Ala, Gly, Leu, or Ile
  SITE (961)..(961): Xaa at position 961 is Leu, Ala, Val, Gly, or Ile
  SITE (964)..(964): Xaa at position 964 is Leu, Ala, Val, Gly, or Ile
  SITE (968)..(968): Xaa at position 968 is Val, Ala, Gly, Leu, or Ile
  SITE (983)..(983): Xaa at position 983 is Ile, Ala, Val, Leu, or Gly
  SITE (990)..(990): Xaa at position 990 is Leu, Ala, Val, Gly, or Ile
  SITE (997)..(997): Xaa at position 997 is Leu, Ala, Val, Gly, or Ile
  SITE (1004)..(1004): Xaa at position 1004 is Ala, Gly, or Pro
  SITE (1020)..(1020): Xaa at position 1020 is Met, Ile, Leu, Val, Ala, or Gly
  SITE (1024)..(1024): Xaa at position 1024 is Ala, Gly, or Pro
  SITE (1027)..(1027): Xaa at position 1027 is Leu, Ala, Val, Gly, or Ile
  SITE (1028)..(1028): Xaa at position 1028 is Ala, Gly, or Pro
  SITE (1031)..(1031): Xaa at position 1031 is Ala, Gly, or Pro
  SITE (1034)..(1034): Xaa at position 1034 is Leu, Ala, Val, Gly, or Ile
  SITE (1038)..(1038): Xaa at position 1038 is Ile, Ala, Val, Leu, or Gly
  SITE (1041)..(1041): Xaa at position 1041 is Ala, Gly, or Pro
MAAAYLDPNLNHTPNSSTKTHLGTGMERSPGAMERVLKXFHYFESNSEPTTWASIIRXGDATDXRGXXQKIXDSHKVKHVAXYGFRXSHLRSEEVHWLHVDMGVSSVREKYELAHPPEEWKYEXRIRXLPKGFLNQXTEDKPTLNXXXQQVKSDYMLEIXDQVDQEIXLKXGXXEIRRSYWEMRGNAXEKKSNXEVLEKDVGXKRFXPKSLLDSVKXKTLRKLIQQTXRQFANLNREESIXKXXEIXSPVYRFDKECXKCALGSSWIISVEXXXGPEEGXSYLTDKGCNPTHLXDFTQVQTXQYSNSEDKDRKGMXQXKIAGXPEPLTXTXPSLTIXENXXDXXDGYXRLVNGTSQSFIIRPQKEGERXLPSXPKLANSEKQGMRTHAVSVSETDDYAEIIDEEDTYTMPSTRDYEIQRERIELGRCIGEGQFGDXHQGIYMSPENPALAXXXKTCKNXTSDSVREKXLQEXLTXRQFDHPHXVKLIGXXTENPXWXXXELXTLGEXRSFXQVRKYSLDLASLXLXXYQXSTXXAYXESKRFVHRDXXXRNXXXSSNDCXKXGDXGXSRYMEDSTYYKXSKGKLPIKWXXPESINFRRFTSASDXWXXGVXXWEXLMHGVKPFQGVKNNDXIGRXENGERLPMPPNCPPTXYSXXTKXXAYDPSRRPRXTEXKAQXSTILEEEKAQQEERMRMESRRQATVSWDSGGSDEAPPKPSRPGYPSPRSSEGFYPSPQHMVQTNHYQVSGYPGSHGITAMAGSIYPGQASLLDQTDSWNHRPQEIAMWQPNVEDSTVLDLRGIGQVLPTHLMEERLIRQQQEMEEDQRWLEKEERFLKPDVRLSRGSIDREDGSLQGPIGNQHIYQPVGKPDPAAPPKKPPRPGAPGHLGSLASLSSPADSYNEGVKLQPQEISPPPTANLDRSNDKVYENXTGXXKAVIEXSSKXQPAPPEEXVPMVKEXGLAXRTXLATXDETIPLLPASTHREXEMAQKLXNSDLGEXINKMKLXQQYVMTSLQQEYKKQXLTAXHAXXVDXKNXLDVXDQXRLKMLGQTRPH

SEQ ID NO: 641 - protein, 212 aa, Hepatitis B virus
  genotype F2 (isolate Brazil/w4B) (HBV-F)
  SITE (35)..(35): Xaa at position 35 is Tyr, Phe, Met, His, Ile, Leu, Val Ala, or Gly
  SITE (38)..(38): Xaa at position 38 is Phe, Tyr, Met, His, Ile, Leu, Val Ala, or Gly
  SITE (44)..(44): Xaa at position 44 is Leu, Ala, Val, Gly, or Ile
  SITE (45)..(45): Xaa at position 45 is Leu, Ala, Val, Gly, or Ile
  SITE (53)..(53): Xaa at position 53 is Phe, Tyr, Met, His, Ile, Leu, Val Ala, or Gly
  SITE (63)..(63): Xaa at position 63 is Ala, Gly, or Pro
  SITE (81)..(81): Xaa at position 81 is His, Phe, Tyr, Lys, Arg, Gly, Ser Thr, Ala, Val, Leu, Ile, Asn, Met, or Gln
  SITE (84)..(84): Xaa at position 84 is Leu, Ala, Val, Gly, or Ile
  SITE (87)..(87): Xaa at position 87 is Ala, Gly, or Pro
  SITE (98)..(98): Xaa at position 98 is Ala, Gly, or Pro
  SITE (118)..(118): Xaa at position 118 is Val, Ala, Gly, Leu, or Ile
  SITE (129)..(129): Xaa at position 129 is Leu, Ala, Val, Gly, or Ile
  SITE (130)..(130): Xaa at position 130 is Leu, Ala, Val, Gly, or Ile
  SITE (132)..(132): Xaa at position 132 is Phe, Tyr, Met, His, Ile, Leu, Val Ala, or Gly
  SITE (133)..(133): Xaa at position 133 is His, Phe, Tyr, Lys, Arg, Gly, Ser Thr, Ala, Val, Leu, Ile, Asn, Met, or Gln
  SITE (144)..(144): Xaa at position 144 is Val, Ala, Gly, Leu, or Ile
  SITE (148)..(148): Xaa at position 148 is Leu, Ala, Val, Gly, or Ile
MQLFHLCLIIFCSCPTVQASKLCLGWLWGMDIDPXKEXGASVEXXSFLPSDFXPSVRDLLDTXSALYRDALESPEHCTPNXTAXRQXILCWGELMTLXSWVGNNLEDPAARDLVVNYXNTNMGLKIRQXXWXXISCLTFGRETXLEYXVSFGVWIRTPPAYRPPNAPILSTLPETTVVRRRGRSPRRRTPSPRRRRSQSPRRRRSQSPASQC

SEQ ID NO: 642 - protein, 938 aa, Homo sapiens
  SITE (71)..(71): Xaa at position 71 is Ala, Gly, or Pro
  SITE (107)..(107): Xaa at position 107 is Val, Ala, Gly, Leu, or Ile
  SITE (109)..(109): Xaa at position 109 is Tyr, Phe, Met, His, Ile, Leu, Val Ala, or Gly
  SITE (111)..(111): Xaa at position 111 is Ala, Gly, or Pro
  SITE (158)..(158): Xaa at position 158 is Tyr, Phe, Met, His, Ile, Leu, Val Ala, or Gly
  SITE (163)..(163): Xaa at position 163 is Ile, Ala, Val, Leu, or Gly
  SITE (236)..(236): Xaa at position 236 is Ala, Gly, or Pro
  SITE (269)..(269): Xaa at position 269 is Leu, Ala, Val, Gly, or Ile
  SITE (279)..(279): Xaa at position 279 is Ala, Gly, or Pro
  SITE (284)..(284): Xaa at position 284 is Ala, Gly, or Pro
  SITE (301)..(301): Xaa at position 301 is Ile, Ala, Val, Leu, or Gly
  SITE (309)..(309): Xaa at position 309 is Val, Ala, Gly, Leu, or Ile
  SITE (314)..(314): Xaa at position 314 is Ile, Ala, Val, Leu, or Gly
  SITE (400)..(400): Xaa at position 400 is Ile, Ala, Val, Leu, or Gly
  SITE (401)..(401): Xaa at position 401 is Val, Ala, Gly, Leu, or Ile
  SITE (408)..(408): Xaa at position 408 is Phe, Tyr, Met, His, Ile, Leu, Val Ala, or Gly
  SITE (409)..(409): Xaa at position 409 is Val, Ala, Gly, Leu, or Ile
  SITE (436)..(436): Xaa at position 436 is Cys, Ala, Val, Gly, Ser, or Thr
  SITE (454)..(454): Xaa at position 454 is Cys, Ala, Val, Gly, Ser, or Thr
  SITE (455)..(455): Xaa at position 455 is Cys, Ala, Val, Gly, Ser, or Thr
  SITE (458)..(458): Xaa at position 458 is Phe, Tyr, Met, His, Ile, Leu, Val Ala, or Gly
  SITE (459)..(459): Xaa at position 459 is Cys, Ala, Val, Gly, Ser, or Thr
  SITE (460)..(460): Xaa at position 460 is Ile, Ala, Val, Leu, or Gly
  SITE (462)..(462): Xaa at position 462 is Leu, Ala, Val, Gly, or Ile
  SITE (463)..(463): Xaa at position 463 is Leu, Ala, Val, Gly, or Ile
  SITE (466)..(466): Xaa at position 466 is Leu, Ala, Val, Gly, or Ile
  SITE (479)..(479): Xaa at position 479 is Val, Ala, Gly, Leu, or Ile
  SITE (501)..(501): Xaa at position 501 is Met, Ile, Leu, Val, Ala, or Gly
  SITE (502)..(502): Xaa at position 502 is Met, Ile, Leu, Val, Ala, or Gly
  SITE (505)..(505): Xaa at position 505 is Leu, Ala, Val, Gly, or Ile
  SITE (510)..(510): Xaa at position 510 is Ala, Gly, or Pro
  SITE (512)..(512): Xaa at position 512 is Met, Ile, Leu, Val, Ala, or Gly
  SITE (513)..(513): Xaa at position 513 is Ile, Ala, Val, Leu, or Gly
  SITE (514)..(514): Xaa at position 514 is Val, Ala, Gly, Leu, or Ile
  SITE (515)..(515): Xaa at position 515 is Ala, Gly, or Pro
  SITE (517)..(517): Xaa at position 517 is Leu, Ala, Val, Gly, or Ile
  SITE (538)..(538): Xaa at position 538 is Leu, Ala, Val, Gly, or Ile
  SITE (540)..(540): Xaa at position 540 is Ile, Ala, Val, Leu, or Gly
  SITE (541)..(541): Xaa at position 541 is Leu, Ala, Val, Gly, or Ile
  SITE (542)..(542): Xaa at position 542 is Val, Ala, Gly, Leu, or Ile
  SITE (672)..(672): Xaa at position 672 is Leu, Ala, Val, Gly, or Ile
  SITE (681)..(681): Xaa at position 681 is Tyr, Phe, Met, His, Ile, Leu, Val Ala, or Gly
  SITE (682)..(682): Xaa at position 682 is Ala, Gly, or Pro
  SITE (689)..(689): Xaa at position 689 is Val, Ala, Gly, Leu, or Ile
  SITE (693)..(693): Xaa at position 693 is Phe, Tyr, Met, His, Ile, Leu, Val Ala, or Gly
  SITE (702)..(702): Xaa at position 702 is Met, Ile, Leu, Val, Ala, or Gly
  SITE (703)..(703): Xaa at position 703 is Tyr, Phe, Met, His, Ile, Leu, Val Ala, or Gly
  SITE (706)..(706): Xaa at position 706 is Met, Ile, Leu, Val, Ala, or Gly
  SITE (717)..(717): Xaa at position 717 is Ala, Gly, or Pro
  SITE (721)..(721): Xaa at position 721 is Val, Ala, Gly, Leu, or Ile
  SITE (726)..(726): Xaa at position 726 is Leu, Ala, Val, Gly, or Ile
  SITE (728)..(728): Xaa at position 728 is Ala, Gly, or Pro
  SITE (729)..(729): Xaa at position 729 is Phe, Tyr, Met, His, Ile, Leu, Val Ala, or Gly
  SITE (730)..(730): Xaa at position 730 is Ile, Ala, Val, Leu, or Gly
  SITE (731)..(731): Xaa at position 731 is Trp, Tyr, Phe, Met, His, Ile, Leu Val, Ala, or Gly
  SITE (735)..(735): Xaa at position 735 is Val, Ala, Gly, Leu, or Ile
  SITE (736)..(736): Xaa at position 736 is Leu, Ala, Val, Gly, or Ile
  SITE (738)..(738): Xaa at position 738 is Phe, Tyr, Met, His, Ile, Leu, Val Ala, or Gly
  SITE (746)..(746): Xaa at position 746 is Leu, Ala, Val, Gly, or Ile
  SITE (758)..(758): Xaa at position 758 is Phe, Tyr, Met, His, Ile, Leu, Val Ala, or Gly
  SITE (760)..(760): Xaa at position 760 is Ile, Ala, Val, Leu, or Gly
  SITE (762)..(762): Xaa at position 762 is Met, Ile, Leu, Val, Ala, or Gly
  SITE (772)..(772): Xaa at position 772 is Val, Ala, Gly, Leu, or Ile
  SITE (776)..(776): Xaa at position 776 is Ile, Ala, Val, Leu, or Gly
MSTMRLLTLALLFSCSVARAACDPKIVNIGAVLSTRKHEQMFREAVNQANKRHGSWKIQLNATSVTHKPNXIQMALSVCEDLISSQVYAILVSHPPTPNDHFTPTPXSXTXGFYRIPVLGLTTRMSIYSDKSIHLSFLRTVPPYSHQSSVWFEMMRVXSWNHXILLVSDDHEGRAAQKRLETLLEERESKAEKVLQFDPGTKNVTALLMEAKELEARVIILSASEDDAATVYRAAXMLNMTGSGYVWLVGEREISGNALRYAPDGILGXQLINGKNESXHISDXVGVVAQAVHELLEKENXTDPPRGCXGNTNXWKTGPLFKRVLMSSKYADGVTGRVEFNEDGDRKFANYSIMNLQNRKLVQVGIYNGTHVIPNDRKIIWPGGETEKPRGYQMSTRLKXXTIHQEPXXYVKPTLSDGTCKEEFTVNGDPVKKVIXTGPNDTSPGSPRHTVPQXXYGXXXDXXIKXARTMNFTYEVHLXADGKFGTQERVNNSNKKEWNGXXGEXLSGQXDXXXXPXTINNERAQYIEFSKPFKYQGXTXXXKKEIPRSTLDSFMQPFQSTLWLLVGLSVHVVAVMLYLLDRFSPFGRFKVNSEEEEEDALTLSSAMWFSWGVLLNSGIGEGAPRSFSARILGMVWAGFAMIIVASYTANLAAFLVLDRPEERITGINDPRXRNPSDKFIXXTVKQSSXDIYXRRQVELSTXXRHXEKHNYESAAEXIQAXRDNKXHXXXXDSAXXEXEASQKCDXVTTGELFFRSGXGXGXRKDSPWKQNXSLSXLKSHENGFMEDLDKTWVRYQECDSRSNAPATLTFENMAGVFMLVAGGIVAGIFLIFIEIAYKRHKDARRKQMQLAFAAVNVWRKNLQDRKSGRAEPDPKKKATFRAITSTLASSFKRRRSSKDTSTGGGRGALQNQKDTVLPRRAIEREEGQLQLCSRHRES

SEQ ID NO: 643 - protein, 597 aa, Homo sapiens
  SITE (6)..(6): Xaa at position 6 is Trp, Tyr, Phe, Met, His, Ile, Leu Val, Ala, or Gly
  SITE (7)..(7): Xaa at position 7 is Phe, Tyr, Met, His, Ile, Leu, Val Ala, or Gly
  SITE (8)..(8): Xaa at position 8 is His, Phe, Tyr, Lys, Arg, Gly, Ser Thr, Ala, Val, Leu, Ile, Asn, Met, or Gln
  SITE (16)..(16): Xaa at position 16 is Ala, Gly, or Pro
  SITE (19)..(19): Xaa at position 19 is Leu, Ala, Val, Gly, or Ile
  SITE (20)..(20): Xaa at position 20 is Leu, Ala, Val, Gly, or Ile
  SITE (29)..(29): Xaa at position 29 is Phe, Tyr, Met, His, Ile, Leu, Val Ala, or Gly
  SITE (30)..(30): Xaa at position 30 is Leu, Ala, Val, Gly, or Ile
  SITE (31)..(31): Xaa at position 31 is Ala, Gly, or Pro
  SITE (43)..(43): Xaa at position 43 is Leu, Ala, Val, Gly, or Ile
  SITE (45)..(45): Xaa at position 45 is Val, Ala, Gly, Leu, or Ile
  SITE (54)..(54): Xaa at position 54 is Ile, Ala, Val, Leu, or Gly
  SITE (56)..(56): Xaa at position 56 is Ile, Ala, Val, Leu, or Gly
  SITE (63)..(63): Xaa at position 63 is Tyr, Phe, Met, His, Ile, Leu, Val Ala, or Gly
  SITE (65)..(65): Xaa at position 65 is Leu, Ala, Val, Gly, or Ile
  SITE (71)..(71): Xaa at position 71 is Phe, Tyr, Met, His, Ile, Leu, Val Ala, or Gly
  SITE (72)..(72): Xaa at position 72 is Ala, Gly, or Pro
  SITE (74)..(74): Xaa at position 74 is Leu, Ala, Val, Gly, or Ile
  SITE (75)..(75): Xaa at position 75 is Ala, Gly, or Pro
  SITE (77)..(77): Xaa at position 77 is Leu, Ala, Val, Gly, or Ile
  SITE (78)..(78): Xaa at position 78 is Val, Ala, Gly, Leu, or Ile
  SITE (81)..(81): Xaa at position 81 is Tyr, Phe, Met, His, Ile, Leu, Val Ala, or Gly
  SITE (88)..(88): Xaa at position 88 is Leu, Ala, Val, Gly, or Ile
  SITE (96)..(96): Xaa at position 96 is Ile, Ala, Val, Leu, or Gly
  SITE (98)..(98): Xaa at position 98 is Leu, Ala, Val, Gly, or Ile
  SITE (102)..(102): Xaa at position 102 is Leu, Ala, Val, Gly, or Ile
  SITE (122)..(122): Xaa at position 122 is Ala, Gly, or Pro
  SITE (125)..(125): Xaa at position 125 is Leu, Ala, Val, Gly, or Ile
  SITE (126)..(126): Xaa at position 126 is Leu, Ala, Val, Gly, or Ile
  SITE (135)..(135): Xaa at position 135 is Phe, Tyr, Met, His, Ile, Leu, Val Ala, or Gly
  SITE (136)..(136): Xaa at position 136 is Leu, Ala, Val, Gly, or Ile
  SITE (137)..(137): Xaa at position 137 is Val, Ala, Gly, Leu, or Ile
  SITE (147)..(147): Xaa at position 147 is Phe, Tyr, Met, His, Ile, Leu, Val Ala, or Gly
  SITE (148)..(148): Xaa at position 148 is Val, Ala, Gly, Leu, or Ile
  SITE (149)..(149): Xaa at position 149 is Leu, Ala, Val, Gly, or Ile
  SITE (151)..(151): Xaa at position 151 is Val, Ala, Gly, Leu, or Ile
  SITE (172)..(172): Xaa at position 172 is Ile, Ala, Val, Leu, or Gly
  SITE (190)..(190): Xaa at position 190 is Leu, Ala, Val, Gly, or Ile
  SITE (193)..(193): Xaa at position 193 is Leu, Ala, Val, Gly, or Ile
  SITE (194)..(194): Xaa at position 194 is Val, Ala, Gly, Leu, or Ile
  SITE (209)..(209): Xaa at position 209 is Val, Ala, Gly, Leu, or Ile
  SITE (210)..(210): Xaa at position 210 is Leu, Ala, Val, Gly, or Ile
  SITE (212)..(212): Xaa at position 212 is Leu, Ala, Val, Gly, or Ile
  SITE (216)..(216): Xaa at position 216 is Leu, Ala, Val, Gly, or Ile
  SITE (221)..(221): Xaa at position 221 is Ile, Ala, Val, Leu, or Gly
  SITE (223)..(223): Xaa at position 223 is Ala, Gly, or Pro
  SITE (226)..(226): Xaa at position 226 is Ile, Ala, Val, Leu, or Gly
  SITE (230)..(230): Xaa at position 230 is Val, Ala, Gly, Leu, or Ile
  SITE (233)..(233): Xaa at position 233 is Leu, Ala, Val, Gly, or Ile
  SITE (247)..(247): Xaa at position 247 is Phe, Tyr, Met, His, Ile, Leu, Val Ala, or Gly
  SITE (254)..(254): Xaa at position 254 is Leu, Ala, Val, Gly, or Ile
  SITE (282)..(282): Xaa at position 282 is Ile, Ala, Val, Leu, or Gly
  SITE (283)..(283): Xaa at position 283 is Leu, Ala, Val, Gly, or Ile
  SITE (285)..(285): Xaa at position 285 is Phe, Tyr, Met, His, Ile, Leu, Val Ala, or Gly
  SITE (290)..(290): Xaa at position 290 is Val, Ala, Gly, Leu, or Ile
  SITE (304)..(304): Xaa at position 304 is Tyr, Phe, Met, His, Ile, Leu, Val Ala, or Gly
  SITE (307)..(307): Xaa at position 307 is Ala, Gly, or Pro
  SITE (309)..(309): Xaa at position 309 is Ile, Ala, Val, Leu, or Gly
  SITE (310)..(310): Xaa at position 310 is Ile, Ala, Val, Leu, or Gly
  SITE (327)..(327): Xaa at position 327 is Tyr, Phe, Met, His, Ile, Leu, Val Ala, or Gly
  SITE (328)..(328): Xaa at position 328 is Ile, Ala, Val, Leu, or Gly
  SITE (329)..(329): Xaa at position 329 is Ala, Gly, or Pro
  SITE (333)..(333): Xaa at position 333 is Cys, Ala, Val, Gly, Ser, or Thr
  SITE (338)..(338): Xaa at position 338 is Val, Ala, Gly, Leu, or Ile
  SITE (341)..(341): Xaa at position 341 is Phe, Tyr, Met, His, Ile, Leu, Val Ala, or Gly
  SITE (342)..(342): Xaa at position 342 is Trp, Tyr, Phe, Met, His, Ile, Leu Val, Ala, or Gly
  SITE (344)..(344): Xaa at position 344 is Met, Ile, Leu, Val, Ala, or Gly
  SITE (345)..(345): Xaa at position 345 is Val, Ala, Gly, Leu, or Ile
  SITE (352)..(352): Xaa at position 352 is Val, Ala, Gly, Leu, or Ile
  SITE (353)..(353): Xaa at position 353 is Ile, Ala, Val, Leu, or Gly
  SITE (354)..(354): Xaa at position 354 is Val, Ala, Gly, Leu, or Ile
  SITE (355)..(355): Xaa at position 355 is Met, Ile, Leu, Val, Ala, or Gly
  SITE (367)..(367): Xaa at position 367 is Cys, Ala, Val, Gly, Ser, or Thr
  SITE (370)..(370): Xaa at position 370 is Tyr, Phe, Met, His, Ile, Leu, Val Ala, or Gly
  SITE (371)..(371): Xaa at position 371 is Trp, Tyr, Phe, Met, His, Ile, Leu Val, Ala, or Gly
  SITE (380)..(380): Xaa at position 380 is Tyr, Phe, Met, His, Ile, Leu, Val Ala, or Gly
  SITE (383)..(383): Xaa at position 383 is Met, Ile, Leu, Val, Ala, or Gly
  SITE (385)..(385): Xaa at position 385 is Val, Ala, Gly, Leu, or Ile
  SITE (401)..(401): Xaa at position 401 is Leu, Ala, Val, Gly, or Ile
  SITE (403)..(403): Xaa at position 403 is Leu, Ala, Val, Gly, or Ile
  SITE (419)..(419): Xaa at position 419 is Val, Ala, Gly, Leu, or Ile
  SITE (422)..(422): Xaa at position 422 is Tyr, Phe, Met, His, Ile, Leu, Val Ala, or Gly
  SITE (423)..(423): Xaa at position 423 is His, Phe, Tyr, Lys, Arg, Gly, Ser Thr, Ala, Val, Leu, Ile, Asn, Met, or Gln
  SITE (424)..(424): Xaa at position 424 is Phe, Tyr, Met, His, Ile, Leu, Val Ala, or Gly
  SITE (427)..(427): Xaa at position 427 is Trp, Tyr, Phe, Met, His, Ile, Leu Val, Ala, or Gly
  SITE (439)..(439): Xaa at position 439 is Val, Ala, Gly, Leu, or Ile
  SITE (442)..(442): Xaa at position 442 is Phe, Tyr, Met, His, Ile, Leu, Val Ala, or Gly
  SITE (443)..(443): Xaa at position 443 is Leu, Ala, Val, Gly, or Ile
  SITE (446)..(446): Xaa at position 446 is Val, Ala, Gly, Leu, or Ile
  SITE (453)..(453): Xaa at position 453 is Ile, Ala, Val, Leu, or Gly
  SITE (459)..(459): Xaa at position 459 is Val, Ala, Gly, Leu, or Ile
  SITE (460)..(460): Xaa at position 460 is Val, Ala, Gly, Leu, or Ile
  SITE (461)..(461): Xaa at position 461 is Val, Ala, Gly, Leu, or Ile
  SITE (462)..(462): Xaa at position 462 is His, Phe, Tyr, Lys, Arg, Gly, Ser Thr, Ala, Val, Leu, Ile, Asn, Met, or Gln
  SITE (463)..(463): Xaa at position 463 is Cys, Ala, Val, Gly, Ser, or Thr
  SITE (465)..(465): Xaa at position 465 is Ala, Gly, or Pro
  SITE (467)..(467): Xaa at position 467 is Ile, Ala, Val, Leu, or Gly
  SITE (468)..(468): Xaa at position 468 is Gly, Ala, or Pro
  SITE (473)..(473): Xaa at position 473 is Phe, Tyr, Met, His, Ile, Leu, Val Ala, or Gly
  SITE (474)..(474): Xaa at position 474 is Ile, Ala, Val, Leu, or Gly
  SITE (475)..(475): Xaa at position 475 is Val, Ala, Gly, Leu, or Ile
  SITE (476)..(476): Xaa at position 476 is Ile, Ala, Val, Leu, or Gly
  SITE (478)..(478): Xaa at position 478 is Ile, Ala, Val, Leu, or Gly
  SITE (479)..(479): Xaa at position 479 is Leu, Ala, Val, Gly, or Ile
  SITE (480)..(480): Xaa at position 480 is Ile, Ala, Val, Leu, or Gly
  SITE (482)..(482): Xaa at position 482 is Ile, Ala, Val, Leu, or Gly
  SITE (483)..(483): Xaa at position 483 is Ile, Ala, Val, Leu, or Gly
  SITE (488)..(488): Xaa at position 488 is Val, Ala, Gly, Leu, or Ile
  SITE (492)..(492): Xaa at position 492 is Ile, Ala, Val, Leu, or Gly
  SITE (494)..(494): Xaa at position 494 is Val, Ala, Gly, Leu, or Ile
  SITE (498)..(498): Xaa at position 498 is Ile, Ala, Val, Leu, or Gly
  SITE (501)..(501): Xaa at position 501 is Val, Ala, Gly, Leu, or Ile
  SITE (508)..(508): Xaa at position 508 is Met, Ile, Leu, Val, Ala, or Gly
  SITE (509)..(509): Xaa at position 509 is Val, Ala, Gly, Leu, or Ile
  SITE (515)..(515): Xaa at position 515 is Tyr, Phe, Met, His, Ile, Leu, Val Ala, or Gly
  SITE (517)..(517): Xaa at position 517 is Phe, Tyr, Met, His, Ile, Leu, Val Ala, or Gly
  SITE (518)..(518): Xaa at position 518 is Ile, Ala, Val, Leu, or Gly
  SITE (519)..(519): Xaa at position 519 is Tyr, Phe, Met, His, Ile, Leu, Val Ala, or Gly
  SITE (521)..(521): Xaa at position 521 is Ala, Gly, or Pro
  SITE (522)..(522): Xaa at position 522 is Val, Ala, Gly, Leu, or Ile
  SITE (526)..(526): Xaa at position 526 is Ile, Ala, Val, Leu, or Gly
MTSRRXXXPNITGVEXENXXLTRGVDGSXXXRPSKSNPGDFTXSXRRNGAVTHXKXQNTGDYXDXYGGEKXXTXXEXXQYXMEHHGQXKEKNGDVXEXKYPXNCADPTSERWFHGHLSGKEXEKXXTEKGKHGSXXXRESQSHPGDXXXSXRTGDDKGESNDGKSKVTHVMXRCQELKYDVGGGERFDSXTDXXEHYKKNPMVETLGTXXQXKQPXNTTRXNXAEXESRXREXSKLAETTDKVKQGXWEEFETXQQQECKLLYSRKEGQRQENKNKNRYKNXXPXDHTRXVLHDGDPNEPVSDXINXNXXMPEFETKCNNSKPKKSXXXTQGXLQNTXNDXXRXXFQENSRXXXXTTKEVERGKSKXVKXXPDEYALKEXGVXRXRNVKESAAHDYTLREXKXSKVGQALLQGNTERTXWQXXXRTXPDHGVPSDPGGXLDXXEEXHHKQESXMDAGPXXXXXSXGXXRTGTXXXXDXXXDXXREKGXDCDXDXPKTXQMXRSQRSGXXQTEAQXRXXXMXXQHYXETLQRRIEEEQKSKRKGHEYTNIKYSLADQTSGDQSPLPPCTPTPPCAEMREDSARVYENVGLMQQQKSFR

SEQ ID NO: 644 - protein, 659 aa, Homo sapiens
  SITE (31)..(31): Xaa at position 31 is Leu, Ala, Val, Gly, or Ile
  SITE (427)..(427): Xaa at position 427 is Val, Ala, Gly, Leu, or Ile
  SITE (429)..(429): Xaa at position 429 is Ile, Ala, Val, Leu, or Gly
  SITE (432)..(432): Xaa at position 432 is Ile, Ala, Val, Leu, or Gly
  SITE (442)..(442): Xaa at position 442 is Phe, Tyr, Met, His, Ile, Leu, Val Ala, or Gly
  SITE (446)..(446): Xaa at position 446 is Ala, Gly, or Pro
  SITE (449)..(449): Xaa at position 449 is Met, Ile, Leu, Val, Ala, or Gly
  SITE (450)..(450): Xaa at position 450 is Met, Ile, Leu, Val, Ala, or Gly
  SITE (452)..(452): Xaa at position 452 is Leu, Ala, Val, Gly, or Ile
  SITE (457)..(457): Xaa at position 457 is Leu, Ala, Val, Gly, or Ile
  SITE (458)..(458): Xaa at position 458 is Val, Ala, Gly, Leu, or Ile
  SITE (463)..(463): Xaa at position 463 is Val, Ala, Gly, Leu, or Ile
  SITE (464)..(464): Xaa at position 464 is Cys, Ala, Val, Gly, Ser, or Thr
  SITE (470)..(470): Xaa at position 470 is Ile, Ala, Val, Leu, or Gly
  SITE (472)..(472): Xaa at position 472 is Ile, Ala, Val, Leu, or Gly
  SITE (473)..(473): Xaa at position 473 is Ile, Ala, Val, Leu, or Gly
  SITE (482)..(482): Xaa at position 482 is Leu, Ala, Val, Gly, or Ile
  SITE (486)..(486): Xaa at position 486 is Leu, Ala, Val, Gly, or Ile
  SITE (498)..(498): Xaa at position 498 is Leu, Ala, Val, Gly, or Ile
  SITE (501)..(501): Xaa at position 501 is Met, Ile, Leu, Val, Ala, or Gly
  SITE (502)..(502): Xaa at position 502 is Cys, Ala, Val, Gly, Ser, or Thr
  SITE (505)..(505): Xaa at position 505 is Val, Ala, Gly, Leu, or Ile
  SITE (506)..(506): Xaa at position 506 is Cys, Ala, Val, Gly, Ser, or Thr
  SITE (508)..(508): Xaa at position 508 is Ala, Gly, or Pro
  SITE (509)..(509): Xaa at position 509 is Met, Ile, Leu, Val, Ala, or Gly
  SITE (512)..(512): Xaa at position 512 is Leu, Ala, Val, Gly, or Ile
  SITE (519)..(519): Xaa at position 519 is His, Phe, Tyr, Lys, Arg, Gly, Ser Thr, Ala, Val, Leu, Ile, Asn, Met, or Gln
  SITE (522)..(522): Xaa at position 522 is Leu, Ala, Val, Gly, or Ile
  SITE (523)..(523): Xaa at position 523 is Ala, Gly, or Pro
  SITE (524)..(524): Xaa at position 524 is Ala, Gly, or Pro
  SITE (527)..(527): Xaa at position 527 is Cys, Ala, Val, Gly, Ser, or Thr
  SITE (529)..(529): Xaa at position 529 is Val, Ala, Gly, Leu, or Ile
  SITE (535)..(535): Xaa at position 535 is Val, Ala, Gly, Leu, or Ile
  SITE (537)..(537): Xaa at position 537 is Val, Ala, Gly, Leu, or Ile
  SITE (540)..(540): Xaa at position 540 is Phe, Tyr, Met, His, Ile, Leu, Val Ala, or Gly
  SITE (542)..(542): Xaa at position 542 is Leu, Ala, Val, Gly, or Ile
  SITE (568)..(568): Xaa at position 568 is Val, Ala, Gly, Leu, or Ile
  SITE (580)..(580): Xaa at position 580 is Ile, Ala, Val, Leu, or Gly
  SITE (581)..(581): Xaa at position 581 is Trp, Tyr, Phe, Met, His, Ile, Leu Val, Ala, or Gly
  SITE (583)..(583): Xaa at position 583 is Phe, Tyr, Met, His, Ile, Leu, Val Ala, or Gly
  SITE (585)..(585): Xaa at position 585 is Val, Ala, Gly, Leu, or Ile
  SITE (586)..(586): Xaa at position 586 is Leu, Ala, Val, Gly, or Ile
  SITE (587)..(587): Xaa at position 587 is Met, Ile, Leu, Val, Ala, or Gly
  SITE (588)..(588): Xaa at position 588 is Trp, Tyr, Phe, Met, His, Ile, Leu Val, Ala, or Gly
  SITE (590)..(590): Xaa at position 590 is Ile, Ala, Val, Leu, or Gly
  SITE (591)..(591): Xaa at position 591 is Tyr, Phe, Met, His, Ile, Leu, Val Ala, or Gly
  SITE (598)..(598): Xaa at position 598 is Tyr, Phe, Met, His, Ile, Leu, Val Ala, or Gly
  SITE (610)..(610): Xaa at position 610 is Ile, Ala, Val, Leu, or Gly
  SITE (616)..(616): Xaa at position 616 is Leu, Ala, Val, Gly, or Ile
  SITE (622)..(622): Xaa at position 622 is Ala, Gly, or Pro
  SITE (626)..(626): Xaa at position 626 is Val, Ala, Gly, Leu, or Ile
  SITE (630)..(630): Xaa at position 630 is Met, Ile, Leu, Val, Ala, or Gly
  SITE (633)..(633): Xaa at position 633 is Cys, Ala, Val, Gly, Ser, or Thr
  SITE (634)..(634): Xaa at position 634 is Trp, Tyr, Phe, Met, His, Ile, Leu Val, Ala, or Gly
  SITE (644)..(644): Xaa at position 644 is Phe, Tyr, Met, His, Ile, Leu, Val Ala, or Gly
  SITE (647)..(647): Xaa at position 647 is Leu, Ala, Val, Gly, or Ile
  SITE (651)..(651): Xaa at position 651 is Ile, Ala, Val, Leu, or Gly
MAAVILESIFLKRSQQKKKTSPLNFKKRLFXLTVHKLSYYEYDFERGRRGSKKGSIDVEKITCVETVVPEKNPPPERQIPRRGEESSEMEQISIIERFPYPFQVVYDEGPLYVFSPTEELRKRWIHQLKNVIRYNSDLVQKYHPCFWIDGQYLCCSQTAKNAMGCQILENRNGSLKPGSSHRKTKKPLPPTPEEDQILKKPLPPEPAAAPVSTSELKKVVALYDYMPMNANDLQLRKGDEYFILEESNLPWWRARDKNGQEGYIPSNYVTEAEDSIEMYEWYSKHMTRSQAEQLLKQEGKEGGFIVRDSSKAGKYTVSVFAKSTGDPQGVIRHYVVCSTPQSQYYLAEKHLFSTIPELINYHQHNSAGLISRLKYPVSQQNKNAPSTAGLGYGSWEIDPKDLTFLKELGTGQFGVVKYGKWRGQYDXAXKMXKEGSMSEDEXIEEXKVXXNXSHEKXXQLYGXXTKQRPXFXXTEYMANGCXLNYXREMRHRFQTQQXLEXXKDXXEXXEYXESKQFLXRDXXXRNXLXNDQGVXKXSDXGXSRYVLDDEYTSSVGSKFPVRWSPPEXLMYSKFSSKSDXXAXGXXXXEXXSLGKMPXERFTNSETAEHXAQGLRXYRPHLXSEKXYTIXYSXXHEKADERPTXKIXLSNXLDVMDEES

SEQ ID NO: 645 - protein, 517 aa, Homo sapiens
  SITE (52)..(52): Xaa at position 52 is Val, Ala, Gly, Leu, or Ile
  SITE (54)..(54): Xaa at position 54 is Val, Ala, Gly, Leu, or Ile
  SITE (56)..(56): Xaa at position 56 is Leu, Ala, Val, Gly, or Ile
  SITE (58)..(58): Xaa at position 58 is Leu, Ala, Val, Gly, or Ile
  SITE (79)..(79): Xaa at position 79 is Ile, Ala, Val, Leu, or Gly
  SITE (83)..(83): Xaa at position 83 is Trp, Tyr, Phe, Met, His, Ile, Leu Val, Ala, or Gly
  SITE (108)..(108): Xaa at position 108 is Val, Ala, Gly, Leu, or Ile
  SITE (109)..(109): Xaa at position 109 is Trp, Tyr, Phe, Met, His, Ile, Leu Val, Ala, or Gly
  SITE (115)..(115): Xaa at position 115 is Leu, Ala, Val, Gly, or Ile
  SITE (131)..(131): Xaa at position 131 is Val, Ala, Gly, Leu, or Ile
  SITE (133)..(133): Xaa at position 133 is Val, Ala, Gly, Leu, or Ile
  SITE (139)..(139): Xaa at position 139 is Val, Ala, Gly, Leu, or Ile
  SITE (141)..(141): Xaa at position 141 is Trp, Tyr, Phe, Met, His, Ile, Leu Val, Ala, or Gly
  SITE (145)..(145): Xaa at position 145 is Ala, Gly, or Pro
  SITE (151)..(151): Xaa at position 151 is Cys, Ala, Val, Gly, Ser, or Thr
  SITE (153)..(153): Xaa at position 153 is Ile, Ala, Val, Leu, or Gly
  SITE (162)..(162): Xaa at position 162 is Trp, Tyr, Phe, Met, His, Ile, Leu Val, Ala, or Gly
  SITE (169)..(169): Xaa at position 169 is Phe, Tyr, Met, His, Ile, Leu, Val Ala, or Gly
  SITE (179)..(179): Xaa at position 179 is Ile, Ala, Val, Leu, or Gly
  SITE (181)..(181): Xaa at position 181 is Leu, Ala, Val, Gly, or Ile
  SITE (253)..(253): Xaa at position 253 is Ile, Ala, Val, Leu, or Gly
  SITE (330)..(330): Xaa at position 330 is Val, Ala, Gly, Leu, or Ile
MEGPVLTLGLLAALAVCGSWGLNEEERLIRHLFQEKGYNKELRPVAHKEESXDXAXAXTLSNLISLKEVEETLTTNVWXEHGXTDNRLKWNAEEFGNISVLRLPPDMXXLPEIVXENNNDGSFQISYSCNXLXYHYGFXYXLPPXIFRSSXPXSVTYFPFDXQNCSLKXSSLKYTAKEXTXSLKQDAKENRTYPVEWIIIDPEGFTENGEWEIVHRPARVNVDPRAPLDSPSRQDITFYLIIRRKPLFYIINXLVPCVLISFMVNLVFYLPADSGEKTSVAISVLLAQSVFLLLISKRLPATSMAIPLIGKFLLFGMVLVTMVVVICVIXLNIHFRTPSTHVLSEGVKKLFLETLPELLHMSRPAEDGPSPGALVRRSSSLGYISKAEEYFLLKSRSDLMFEKQSERHGLARRLTTARRPPASSEQAQQELFNELKPAVDGANFIVNHMRDQNNYNEEKDSWNRVARTVDRLCLFVVTPVMVVGTAWIFLQGVYNQPPPQPFPGDPYSYNVQDKRFI

SEQ ID NO: 646 - protein, 199 aa, Homo sapiens
  SITE (97)..(97): Xaa at position 97 is Tyr, Phe, Met, His, Ile, Leu, Val Ala, or Gly
  SITE (109)..(109): Xaa at position 109 is Ala, Gly, or Pro
  SITE (113)..(113): Xaa at position 113 is Cys, Ala, Val, Gly, Ser, or Thr
  SITE (120)..(120): Xaa at position 120 is Leu, Ala, Val, Gly, or Ile
  SITE (121)..(121): Xaa at position 121 is Ala, Gly, or Pro
  SITE (123)..(123): Xaa at position 123 is Ile, Ala, Val, Leu, or Gly
  SITE (132)..(132): Xaa at position 132 is Leu, Ala, Val, Gly, or Ile
  SITE (142)..(142): Xaa at position 142 is Trp, Tyr, Phe, Met, His, Ile, Leu Val, Ala, or Gly
  SITE (143)..(143): Xaa at position 143 is Val, Ala, Gly, Leu, or Ile
  SITE (145)..(145): Xaa at position 145 is Leu, Ala, Val, Gly, or Ile
  SITE (173)..(173): Xaa at position 173 is Cys, Ala, Val, Gly, Ser, or Thr
  SITE (174)..(174): Xaa at position 174 is Val, Ala, Gly, Leu, or Ile
  SITE (176)..(176): Xaa at position 176 is Leu, Ala, Val, Gly, or Ile
  SITE (193)..(193): Xaa at position 193 is Ile, Ala, Val, Leu, or Gly
  SITE (194)..(194): Xaa at position 194 is Cys, Ala, Val, Gly, Ser, or Thr
MSSENCFVAENSSLHPESGQENDATSPHFSTRHEGSFQVPVLCAVMNVVFITILIIALIALSVGQYNCPGQYTFSMPSDSHVSSCSEDWVGYQRKCXFISTVKRSWTSXQNAXSEHGATXXVXDSEKDMNFXKRYAGREEHXXGXKKEPGHPWKWSNGKEFNNWFNVTGSDKXXFXKNTEVSSMECEKNLYWXXNKPYK

SEQ ID NO: 647 - protein, 470 aa, Influenza A virus
  strain A/Duck/Ukraine/1/1963 H3N8
  SITE (83)..(83): Xaa at position 83 is Met, Ile, Leu, Val, Ala, or Gly
  SITE (92)..(92): Xaa at position 92 is Ala, Gly, or Pro
  SITE (95)..(95): Xaa at position 95 is Phe, Tyr, Met, His, Ile, Leu, Val Ala, or Gly
  SITE (104)..(104): Xaa at position 104 is Ile, Ala, Val, Leu, or Gly
  SITE (112)..(112): Xaa at position 112 is Ile, Ala, Val, Leu, or Gly
  SITE (114)..(114): Xaa at position 114 is Val, Ala, Gly, Leu, or Ile
  SITE (115)..(115): Xaa at position 115 is Ile, Ala, Val, Leu, or Gly
  SITE (119)..(119): Xaa at position 119 is Phe, Tyr, Met, His, Ile, Leu, Val Ala, or Gly
  SITE (120)..(120): Xaa at position 120 is Val, Ala, Gly, Leu, or Ile
  SITE (130)..(130): Xaa at position 130 is Phe, Tyr, Met, His, Ile, Leu, Val Ala, or Gly
  SITE (131)..(131): Xaa at position 131 is Phe, Tyr, Met, His, Ile, Leu, Val Ala, or Gly
  SITE (132)..(132): Xaa at position 132 is Leu, Ala, Val, Gly, or Ile
  SITE (156)..(156): Xaa at position 156 is Leu, Ala, Val, Gly, or Ile
  SITE (159)..(159): Xaa at position 159 is Val, Ala, Gly, Leu, or Ile
  SITE (174)..(174): Xaa at position 174 is Ala, Gly, or Pro
  SITE (176)..(176): Xaa at position 176 is Ala, Gly, or Pro
  SITE (177)..(177): Xaa at position 177 is Trp, Tyr, Phe, Met, His, Ile, Leu Val, Ala, or Gly
  SITE (179)..(179): Xaa at position 179 is Ala, Gly, or Pro
  SITE (181)..(181): Xaa at position 181 is Ala, Gly, or Pro
  SITE (182)..(182): Xaa at position 182 is Cys, Ala, Val, Gly, Ser, or Thr
  SITE (189)..(189): Xaa at position 189 is Met, Ile, Leu, Val, Ala, or Gly
  SITE (191)..(191): Xaa at position 191 is Val, Ala, Gly, Leu, or Ile
  SITE (193)..(193): Xaa at position 193 is Val, Ala, Gly, Leu, or Ile
  SITE (200)..(200): Xaa at position 200 is Ala, Gly, or Pro
  SITE (201)..(201): Xaa at position 201 is Val, Ala, Gly, Leu, or Ile
  SITE (202)..(202): Xaa at position 202 is Ala, Gly, or Pro
  SITE (204)..(204): Xaa at position 204 is Ile, Ala, Val, Leu, or Gly
  SITE (214)..(214): Xaa at position 214 is Val, Ala, Gly, Leu, or Ile
  SITE (222)..(222): Xaa at position 222 is Leu, Ala, Val, Gly, or Ile
  SITE (231)..(231): Xaa at position 231 is Cys, Ala, Val, Gly, Ser, or Thr
  SITE (232)..(232): Xaa at position 232 is Ile, Ala, Val, Leu, or Gly
  SITE (236)..(236): Xaa at position 236 is Cys, Ala, Val, Gly, Ser, or Thr
  SITE (237)..(237): Xaa at position 237 is Tyr, Phe, Met, His, Ile, Leu, Val Ala, or Gly
  SITE (238)..(238): Xaa at position 238 is Trp, Tyr, Phe, Met, His, Ile, Leu Val, Ala, or Gly
  SITE (239)..(239): Xaa at position 239 is Val, Ala, Gly, Leu, or Ile
  SITE (240)..(240): Xaa at position 240 is Met, Ile, Leu, Val, Ala, or Gly
  SITE (249)..(249): Xaa at position 249 is Ala, Gly, or Pro
  SITE (251)..(251): Xaa at position 251 is Tyr, Phe, Met, His, Ile, Leu, Val Ala, or Gly
  SITE (253)..(253): Xaa at position 253 is Ile, Ala, Val, Leu, or Gly
  SITE (256)..(256): Xaa at position 256 is Ala, Gly, or Pro
  SITE (261)..(261): Xaa at position 261 is Ile, Ala, Val, Leu, or Gly
  SITE (273)..(273): Xaa at position 273 is His, Phe, Tyr, Lys, Arg, Gly, Ser Thr, Ala, Val, Leu, Ile, Asn, Met, or Gln
  SITE (274)..(274): Xaa at position 274 is Ile, Ala, Val, Leu, or Gly
  SITE (277)..(277): Xaa at position 277 is Cys, Ala, Val, Gly, Ser, or Thr
  SITE (279)..(279): Xaa at position 279 is Cys, Ala, Val, Gly, Ser, or Thr
  SITE (280)..(280): Xaa at position 280 is Tyr, Phe, Met, His, Ile, Leu, Val Ala, or Gly
  SITE (286)..(286): Xaa at position 286 is Val, Ala, Gly, Leu, or Ile
  SITE (288)..(288): Xaa at position 288 is Cys, Ala, Val, Gly, Ser, or Thr
  SITE (289)..(289): Xaa at position 289 is Val, Ala, Gly, Leu, or Ile
  SITE (290)..(290): Xaa at position 290 is Cys, Ala, Val, Gly, Ser, or Thr
  SITE (302)..(302): Xaa at position 302 is Leu, Ala, Val, Gly, or Ile
  SITE (304)..(304): Xaa at position 304 is Ile, Ala, Val, Leu, or Gly
  SITE (315)..(315): Xaa at position 315 is Leu, Ala, Val, Gly, or Ile
  SITE (316)..(316): Xaa at position 316 is Cys, Ala, Val, Gly, Ser, or Thr
  SITE (317)..(317): Xaa at position 317 is Ala, Gly, or Pro
  SITE (319)..(319): Xaa at position 319 is Ile, Ala, Val, Leu, or Gly
  SITE (346)..(346): Xaa at position 346 is Val, Ala, Gly, Leu, or Ile
  SITE (349)..(349): Xaa at position 349 is Phe, Tyr, Met, His, Ile, Leu, Val Ala, or Gly
  SITE (351)..(351): Xaa at position 351 is Phe, Tyr, Met, His, Ile, Leu, Val Ala, or Gly
  SITE (357)..(357): Xaa at position 357 is Val, Ala, Gly, Leu, or Ile
  SITE (358)..(358): Xaa at position 358 is Trp, Tyr, Phe, Met, His, Ile, Leu Val, Ala, or Gly
  SITE (359)..(359): Xaa at position 359 is Met, Ile, Leu, Val, Ala, or Gly
  SITE (363)..(363): Xaa at position 363 is Ile, Ala, Val, Leu, or Gly
  SITE (371)..(371): Xaa at position 371 is Phe, Tyr, Met, His, Ile, Leu, Val Ala, or Gly
  SITE (373)..(373): Xaa at position 373 is Ile, Ala, Val, Leu, or Gly
  SITE (374)..(374): Xaa at position 374 is Leu, Ala, Val, Gly, or Ile
  SITE (376)..(376): Xaa at position 376 is Ile, Ala, Val, Leu, or Gly
  SITE (393)..(393): Xaa at position 393 is Val, Ala, Gly, Leu, or Ile
  SITE (394)..(394): Xaa at position 394 is Val, Ala, Gly, Leu, or Ile
  SITE (397)..(397): Xaa at position 397 is Leu, Ala, Val, Gly, or Ile
  SITE (406)..(406): Xaa at position 406 is Phe, Tyr, Met, His, Ile, Leu, Val Ala, or Gly
  SITE (418)..(418): Xaa at position 418 is Leu, Ala, Val, Gly, or Ile
  SITE (421)..(421): Xaa at position 421 is Cys, Ala, Val, Gly, Ser, or Thr
  SITE (422)..(422): Xaa at position 422 is Phe, Tyr, Met, His, Ile, Leu, Val Ala, or Gly
  SITE (423)..(423): Xaa at position 423 is Trp, Tyr, Phe, Met, His, Ile, Leu Val, Ala, or Gly
  SITE (424)..(424): Xaa at position 424 is Val, Ala, Gly, Leu, or Ile
  SITE (426)..(426): Xaa at position 426 is Met, Ile, Leu, Val, Ala, or Gly
  SITE (437)..(437): Xaa at position 437 is Trp, Tyr, Phe, Met, His, Ile, Leu Val, Ala, or Gly
  SITE (443)..(443): Xaa at position 443 is Ile, Ala, Val, Leu, or Gly
  SITE (444)..(444): Xaa at position 444 is Val, Ala, Gly, Leu, or Ile
  SITE (445)..(445): Xaa at position 445 is Met, Ile, Leu, Val, Ala, or Gly
MNPNQKIITIGSISLGLVVFNVLLHVVSIIVTVLVLGKGGNNGICNETVVREYNETVRIEKVTQWHNTNVVEYVPYWNGGTYXNNTEAICDXKGXAPFSKDNGXRIGSRGHXFXXREPXXSCSPIECRTXXXTQGSLLNDKHSNGTVKDRSPFRTXMSXEVGQSPNVYQARFEXVXXSXTXXHDGKKWXTXGXTGPDSKXXXVXHYGGVPTDVXNSWAGDIXRTQESSCTXXQGDXXXXXTDGPANRQXQXRXYKXNQGRXIGQTDISFNGGXXEEXSXXPNDGKXEXXXRDGWTGTNRPVXVXSPDLSYRVGYXXXGXPSDTPRGEDTQFTGSCTSPMGNQGYGXKGXGXRQGTDXXXGRTXSRTSRSGXEXXRXKNGWTQTSKEQIRKQVXXDNXNWSGYSGSXTLPVELSGKDCXVPXXXXEXIRGKPEEKTIXTSSSSXXXCGVDYEVADWSWHDGAILPFDIDKM

SEQ ID NO: 648 - protein, 4544 aa, Homo sapiens
  SITE (859)..(859): Xaa at position 859 is Phe, Tyr, Met, His, Ile, Leu, Val Ala, or Gly
  SITE (861)..(861): Xaa at position 861 is Cys, Ala, Val, Gly, Ser, or Thr
  SITE (879)..(879): Xaa at position 879 is Cys, Ala, Val, Gly, Ser, or Thr
  SITE (895)..(895): Xaa at position 895 is Cys, Ala, Val, Gly, Ser, or Thr
  SITE (900)..(900): Xaa at position 900 is Phe, Tyr, Met, His, Ile, Leu, Val Ala, or Gly
  SITE (902)..(902): Xaa at position 902 is Cys, Ala, Val, Gly, Ser, or Thr
  SITE (908)..(908): Xaa at position 908 is Ile, Ala, Val, Leu, or Gly
  SITE (914)..(914): Xaa at position 914 is Cys, Ala, Val, Gly, Ser, or Thr
  SITE (920)..(920): Xaa at position 920 is Cys, Ala, Val, Gly, Ser, or Thr
  SITE (936)..(936): Xaa at position 936 is Cys, Ala, Val, Gly, Ser, or Thr
  SITE (943)..(943): Xaa at position 943 is Cys, Ala, Val, Gly, Ser, or Thr
  SITE (955)..(955): Xaa at position 955 is Cys, Ala, Val, Gly, Ser, or Thr
  SITE (961)..(961): Xaa at position 961 is Cys, Ala, Val, Gly, Ser, or Thr
  SITE (982)..(982): Xaa at position 982 is Phe, Tyr, Met, His, Ile, Leu, Val Ala, or Gly
  SITE (984)..(984): Xaa at position 984 is Cys, Ala, Val, Gly, Ser, or Thr
  SITE (1002)..(1002): Xaa at position 1002 is Cys, Ala, Val, Gly, Ser, or Thr
  SITE (1020)..(1020): Xaa at position 1020 is Phe, Tyr, Met, His, Ile, Leu Val, Ala, or Gly
  SITE (1022)..(1022): Xaa at position 1022 is Cys, Ala, Val, Gly, Ser, or Thr
  SITE (1040)..(1040): Xaa at position 1040 is Cys, Ala, Val, Gly, Ser, or Thr
  SITE (1067)..(1067): Xaa at position 1067 is Phe, Tyr, Met, His, Ile, Leu Val, Ala, or Gly
  SITE (1069)..(1069): Xaa at position 1069 is Cys, Ala, Val, Gly, Ser, or Thr
  SITE (1088)..(1088): Xaa at position 1088 is Cys, Ala, Val, Gly, Ser, or Thr
  SITE (1110)..(1110): Xaa at position 1110 is Phe, Tyr, Met, His, Ile, Leu Val, Ala, or Gly
  SITE (1112)..(1112): Xaa at position 1112 is Cys, Ala, Val, Gly, Ser, or Thr
  SITE (1131)..(1131): Xaa at position 1131 is Cys, Ala, Val, Gly, Ser, or Thr
  SITE (1152)..(1152): Xaa at position 1152 is Cys, Ala, Val, Gly, Ser, or Thr
  SITE (1158)..(1158): Xaa at position 1158 is Val, Ala, Gly, Leu, or Ile
  SITE (1160)..(1160): Xaa at position 1160 is Leu, Ala, Val, Gly, or Ile
  SITE (1172)..(1172): Xaa at position 1172 is Cys, Ala, Val, Gly, Ser, or Thr
  SITE (2679)..(2679): Xaa at position 2679 is Cys, Ala, Val, Gly, Ser, or Thr
  SITE (2696)..(2696): Xaa at position 2696 is Cys, Ala, Val, Gly, Ser, or Thr
  SITE (2715)..(2715): Xaa at position 2715 is Cys, Ala, Val, Gly, Ser, or Thr
  SITE (2739)..(2739): Xaa at position 2739 is Phe, Tyr, Met, His, Ile, Leu Val, Ala, or Gly
  SITE (2741)..(2741): Xaa at position 2741 is Cys, Ala, Val, Gly, Ser, or Thr
  SITE (2759)..(2759): Xaa at position 2759 is Cys, Ala, Val, Gly, Ser, or Thr
  SITE (2781)..(2781): Xaa at position 2781 is Cys, Ala, Val, Gly, Ser, or Thr
  SITE (2786)..(2786): Xaa at position 2786 is Val, Ala, Gly, Leu, or Ile
  SITE (2788)..(2788): Xaa at position 2788 is Val, Ala, Gly, Leu, or Ile
  SITE (2793)..(2793): Xaa at position 2793 is Leu, Ala, Val, Gly, or Ile
  SITE (2794)..(2794): Xaa at position 2794 is Cys, Ala, Val, Gly, Ser, or Thr
  SITE (2800)..(2800): Xaa at position 2800 is Cys, Ala, Val, Gly, Ser, or Thr
  SITE (2804)..(2804): Xaa at position 2804 is Ala, Gly, or Pro
  SITE (2812)..(2812): Xaa at position 2812 is Cys, Ala, Val, Gly, Ser, or Thr
  SITE (2818)..(2818): Xaa at position 2818 is Cys, Ala, Val, Gly, Ser, or Thr
  SITE (2837)..(2837): Xaa at position 2837 is Cys, Ala, Val, Gly, Ser, or Thr
  SITE (2863)..(2863): Xaa at position 2863 is Phe, Tyr, Met, His, Ile, Leu Val, Ala, or Gly
  SITE (2865)..(2865): Xaa at position 2865 is Cys, Ala, Val, Gly, Ser, or Thr
  SITE (2884)..(2884): Xaa at position 2884 is Cys, Ala, Val, Gly, Ser, or Thr
  SITE (2912)..(2912): Xaa at position 2912 is Cys, Ala, Val, Gly, Ser, or Thr
  SITE (2930)..(2930): Xaa at position 2930 is Cys, Ala, Val, Gly, Ser, or Thr
  SITE (3379)..(3379): Xaa at position 3379 is Phe, Tyr, Met, His, Ile, Leu Val, Ala, or Gly
  SITE (3381)..(3381): Xaa at position 3381 is Cys, Ala, Val, Gly, Ser, or Thr
  SITE (3399)..(3399): Xaa at position 3399 is Cys, Ala, Val, Gly, Ser, or Thr
  SITE (3453)..(3453): Xaa at position 3453 is Cys, Ala, Val, Gly, Ser, or Thr
  SITE (3458)..(3458): Xaa at position 3458 is Phe, Tyr, Met, His, Ile, Leu Val, Ala, or Gly
  SITE (3460)..(3460): Xaa at position 3460 is Cys, Ala, Val, Gly, Ser, or Thr
  SITE (3467)..(3467): Xaa at position 3467 is Ile, Ala, Val, Leu, or Gly
  SITE (3473)..(3473): Xaa at position 3473 is Cys, Ala, Val, Gly, Ser, or Thr
  SITE (3479)..(3479): Xaa at position 3479 is Cys, Ala, Val, Gly, Ser, or Thr
  SITE (3494)..(3494): Xaa at position 3494 is Cys, Ala, Val, Gly, Ser, or Thr
  SITE (3499)..(3499): Xaa at position 3499 is Phe, Tyr, Met, His, Ile, Leu Val, Ala, or Gly
  SITE (3501)..(3501): Xaa at position 3501 is Cys, Ala, Val, Gly, Ser, or Thr
  SITE (3508)..(3508): Xaa at position 3508 is Ile, Ala, Val, Leu, or Gly
  SITE (3514)..(3514): Xaa at position 3514 is Cys, Ala, Val, Gly, Ser, or Thr
  SITE (3520)..(3520): Xaa at position 3520 is Cys, Ala, Val, Gly, Ser, or Thr
  SITE (3536)..(3536): Xaa at position 3536 is Cys, Ala, Val, Gly, Ser, or Thr
  SITE (3543)..(3543): Xaa at position 3543 is Cys, Ala, Val, Gly, Ser, or Thr
  SITE (3549)..(3549): Xaa at position 3549 is Val, Ala, Gly, Leu, or Ile
  SITE (3555)..(3555): Xaa at position 3555 is Cys, Ala, Val, Gly, Ser, or Thr
  SITE (3561)..(3561): Xaa at position 3561 is Cys, Ala, Val, Gly, Ser, or Thr
  SITE (3575)..(3575): Xaa at position 3575 is Cys, Ala, Val, Gly, Ser, or Thr
  SITE (3580)..(3580): Xaa at position 3580 is Phe, Tyr, Met, His, Ile, Leu Val, Ala, or Gly
  SITE (3582)..(3582): Xaa at position 3582 is Cys, Ala, Val, Gly, Ser, or Thr
  SITE (3588)..(3588): Xaa at position 3588 is Ile, Ala, Val, Leu, or Gly
  SITE (3594)..(3594): Xaa at position 3594 is Cys, Ala, Val, Gly, Ser, or Thr
  SITE (3600)..(3600): Xaa at position 3600 is Cys, Ala, Val, Gly, Ser, or Thr
  SITE (3613)..(3613): Xaa at position 3613 is Cys, Ala, Val, Gly, Ser, or Thr
  SITE (3620)..(3620): Xaa at position 3620 is Cys, Ala, Val, Gly, Ser, or Thr
  SITE (3632)..(3632): Xaa at position 3632 is Cys, Ala, Val, Gly, Ser, or Thr
  SITE (3659)..(3659): Xaa at position 3659 is Phe, Tyr, Met, His, Ile, Leu Val, Ala, or Gly
  SITE (3661)..(3661): Xaa at position 3661 is Cys, Ala, Val, Gly, Ser, or Thr
  SITE (3679)..(3679): Xaa at position 3679 is Cys, Ala, Val, Gly, Ser, or Thr
  SITE (3703)..(3703): Xaa at position 3703 is Cys, Ala, Val, Gly, Ser, or Thr
  SITE (3749)..(3749): Xaa at position 3749 is Cys, Ala, Val, Gly, Ser, or Thr
  SITE (3767)..(3767): Xaa at position 3767 is Cys, Ala, Val, Gly, Ser, or Thr
MLTPPLLLLLPLLSALVAAAIDAPKTCSPKQFACRDQITCISKGWRCDGERDCPDGSDEAPEICPQSKAQRCQPNEHNCLGTELCVPMSRLCNGVQDCMDGSDEGPHCRELQGNCSRLGCQHHCVPTLDGPTCYCNSSFQLQADGKTCKDFDECSVYGTCSQLCTNTDGSFICGCVEGYLLQPDNRSCKAKNEPVDRPPVLLIANSQNILATYLSGAQVSTITPTSTRQTTAMDFSYANETVCWVHVGDSAAQTQLKCARMPGLKGFVDEHTINISLSLHHVEQMAIDWLTGNFYFVDDIDDRIFVCNRNGDTCVTLLDLELYNPKGIALDPAMGKVFFTDYGQIPKVERCDMDGQNRTKLVDSKIVFPHGITLDLVSRLVYWADAYLDYIEVVDYEGKGRQTIIQGILIEHLYGLTVFENYLYATNSDNANAQQKTSVIRVNRFNSTEYQVVTRVDKGGALHIYHQRRQPRVRSHACENDQYGKPGGCSDICLLANSHKARTCRCRSGFSLGSDGKSCKKPEHELFLVYGKGRPGIIRGMDMGAKVPDEHMIPIENLMNPRALDFHAETGFIYFADTTSYLIGRQKIDGTERETILKDGIHNVEGVAVDWMGDNLYWTDDGPKKTISVARLEKAAQTRKTLIEGKMTHPRAIVVDPLNGWMYWTDWEEDPKDSRRGRLERAWMDGSHRDIFVTSKTVLWPNGLSLDIPAGRLYWVDAFYDRIETILLNGTDRKIVYEGPELNHAFGLCHHGNYLFWTEYRSGSVYRLERGVGGAPPTVTLLRSERPPIFEIRMYDAQQQQVGTNKCRVNNGGCSSLCLATPGSRQCACAEDQVLDADGVTCLANPSYVPPPQCQPGEXAXANSRCIQERWKCDGDNDXLDNSDEAPALCHQHTXPSDRXKXENNRCXPNRWLXDGDNDXGNSEDESNATCSARTXPPNQFSXASGRCIPISWTXDLDDDXGDRSDESASCAYPTCFPLTQXTXNNGRCININWRCDNDNDXGDNSDEAGCSHSCSSTQXKXNSGRCIPEHWTCDGDNDXGDYSDETHANCTNQATRPPGGCHTDEXQXRLDGLCIPLRWRCDGDTDXMDSSDEKSCEGVTHVCDPSVKXGXKDSARCISKAWVCDGDNDXEDNSDEENCESLACRPPSHPXANNTSXCXPPDKLCDGNDDXGDGSDEGELCDQCSLNNGGCSHNCSVAPGEGIVCSCPLGMELGPDNHTCQIQSYCAKHLKCSQKCDQNKFSVKCSCYEGWVLEPDGESCRSLDPFKPFIIFSNRHEIRRIDLHKGDYSVLVPGLRNTIALDFHLSQSALYWTDVVEDKIYRGKLLDNGALTSFEVVIQYGLATPEGLAVDWIAGNIYWVESNLDQIEVAKLDGTLRTTLLAGDIEHPRAIALDPRDGILFWTDWDASLPRIEAASMSGAGRRTVHRETGSGGWPNGLTVDYLEKRILWIDARSDAIYSARYDGSGHMEVLRGHEFLSHPFAVTLYGGEVYWTDWRTNTLAKANKWTGHNVTVVQRTNTQPFDLQVYHPSRQPMAPNPCEANGGQGPCSHLCLINYNRTVSCACPHLMKLHKDNTTCYEFKKFLLYARQMEIRGVDLDAPYYNYIISFTVPDIDNVTVLDYDAREQRVYWSDVRTQAIKRAFINGTGVETVVSADLPNAHGLAVDWVSRNLFWTSYDTNKKQINVARLDGSFKNAVVQGLEQPHGLVVHPLRGKLYWTDGDNISMANMDGSNRTLLFSGQKGPVGLAIDFPESKLYWISSGNHTINRCNLDGSGLEVIDAMRSQLGKATALAIMGDKLWWADQVSEKMGTCSKADGSGSVVLRNSTTLVMHMKVYDESIQLDHKGTNPCSVNNGDCSQLCLPTSETTRSCMCTAGYSLRSGQQACEGVGSFLLYSVHEGIRGIPLDPNDKSDALVPVSGTSLAVGIDFHAENDTIYWVDMGLSTISRAKRDQTWREDVVTNGIGRVEGIAVDWIAGNIYWTDQGFDVIEVARLNGSFRYVVISQGLDKPRAITVHPEKGYLFWTEWGQYPRIERSRLDGTERVVLVNVSISWPNGISVDYQDGKLYWCDARTDKIERIDLETGENREVVLSSNNMDMFSVSVFEDFIYWSDRTHANGSIKRGSKDNATDSVPLRTGIGVQLKDIKVFNRDRQKGTNVCAVANGGCQQLCLYRGRGQRACACAHGMLAEDGASCREYAGYLLYSERTILKSIHLSDERNLNAPVQPFEDPEHMKNVIALAFDYRAGTSPGTPNRIFFSDIHFGNIQQINDDGSRRITIVENVGSVEGLAYHRGWDTLYWTSYTTSTITRHTVDQTRPGAFERETVITMSGDDHPRAFVLDECQNLMFWTNWNEQHPSIMRAALSGANVLTLIEKDIRTPNGLAIDHRAEKLYFSDATLDKIERCEYDGSHRYVILKSEPVHPFGLAVYGEHIFWTDWVRRAVQRANKHVGSNMKLLRVDIPQQPMGIIAVANDTNSCELSPCRINNGGCQDLCLLTHQGHVNCSCRGGRILQDDLTCRAVNSSCRAQDEFECANGECINFSLTCDGVPHCKDKSDEKPSYCNSRRCKKTFRQCSNGRCVSNMLWCNGADDCGDGSDEIPCNKTACGVGEFRCRDGTCIGNSSRCNQFVDCEDASDEMNCSATDCSSYFRLGVKGVLFQPCERTSLCYAPSWVCDGANDXGDYSDERDCPGVKRPRXPLNYFACPSGRCIPMSWTXDKEDDCEHGEDETHCNKFCSEAQXEXQNHRCISKQWLCDGSDDXGDGSDEAAHCEGKTCGPSSFSXPGTHXCXPERWXXDGDKDXADGXDESIAAGXLYNSTXDDREFMCQNRQCIPKHFVXDHDRDCADGSDESPECEYPTCGPSEXRXANGRCLSSRQWECDGENDXHDQSDEAPKNPHCTSQEHKCNASSQFLXSSGRCVAEALLCNGQDDXGDSSDERGCHINECLSRKLSGCSQDCEDLKIGFKCRCRPGFRLKDDGRTCADVDECSTTFPCSQRCINTHGSYKCLCVEGYAPRGGDPHSCKAVTDEEPFLIFANRYYLRKLNLDGSNYTLLKQGLNNAVALDFDYREQMIYWTDVTTQGSMIRRMHLNGSNVQVLHRTGLSNPDGLAVDWVGGNLYWCDKGRDTIEVSKLNGAYRTVLVSSGLREPRALVVDVQNGYLYWTDWGDHSLIGRIGMDGSSRSVIVDTKITWPNGLTLDYVTERIYWADAREDYIEFASLDGSNRHVVLSQDIPHIFALTLFEDYVYWTDWETKSINRAHKTTGTNKTLLISTLHRPMDLHVFHALRQPDVPNHPCKVNNGGCSNLCLLSPGGGHKCACPTNFYLGSDGRTCVSNCTASQFVCKNDKCIPFWWKCDTEDDCGDHSDEPPDCPEFKCRPGQXQXSTGICTNPAFICDGDNDXQDNSDEANCDIHVCLPSQFKCTNTNRCIPGIFRCNGQDNCGDGEDERDCPEVTXAPNQXQXSITKRCXPRVWVXDRDNDXVDGSDEPANCTQMTXGVDEXRXKDSGRCXPARWKXDGEDDXGDGSDEPKEECDERTXEPYQFRXKNNRCXPGRWQXDYDNDXGDNSDEESCTPRPXSESEXSXANGRCXAGRWKXDGDHDXADGSDEKDCTPRXDMDQFQXKSGHCIPLRWRXDADADCMDGSDEEACGTGVRTCPLDEXQXNNTLCKPLAWKCDGEDDXGDNSDENPEECARFVCPPNRPFRXKNDRVCLWIGRQCDGTDNCGDGTDEEDCEPPTAHTTHCKDKKEFLXRNQRCLSSSLRCNMFDDXGDGSDEEDCSIDPKLTSCATNASICGDEARCVRTEKAAYCACRSGFHTVPGQPGCQDINECLRFGTCSQLCNNTKGGHLCSCARNFMKTHNTCKAEGSEYQVLYIADDNEIRSLFPGHPHSAYEQAFQGDESVRIDAMDVHVKAGRVYWTNWHTGTISYRSLPPAAPPTTSNRHRRQIDRGVTHLNISGLKMPRGIAIDWVAGNVYWTDSGRDVIEVAQMKGENRKTLISGMIDEPHAIVVDPLRGTMYWSDWGNHPKIETAAMDGTLRETLVQDNIQWPTGLAVDYHNERLYWADAKLSVIGSIRLNGTDPIVAADSKRGLSHPFSIDVFEDYIYGVTYINNRVFKIHKFGHSPLVNLTGGLSHASDVVLYHQHKQPEVTNPCDRKKCEWLCLLSPSGPVCTCPNGKRLDNGTCVPVPSPTPPPDAPRPGTCNLQCFNGGSCFLNARRQPKCRCQPRYTGDKCELDQCWEHCRNGGTCAASPSGMPTCRCPTGFTGPKCTQQVCAGYCANNSTCTVNQGNQPQCRCLPGFLGDRCQYRQCSGYCENFGTCQMAADGSRQCRCTAYFEGSRCEVNKCSRCLEGACVVNKQSGDVTCNCTDGRVAPSCLTCVGHCSNGGSCTMNSKMMPECQCPPHMTGPRCEEHVFSQQQPGHIASILIPLLLLLLLVLVAGVVFWYKRRVQGAKGFQHQRMTNGAMNVEIGNPTYKMYEGGEPDDVGGLLDADFALDPDKPTNFTNPVYATLYMGGHGSRHSLASTDEKRELLGRGPEDEIGDPLA

SEQ ID NO: 649 - protein, 565 aa, Influenza A virus
  strain A/China:Nanchang/11/1996 H1N1
  SITE (7)..(7): Xaa at position 7 is Val, Ala, Gly, Leu, or Ile
  SITE (20)..(20): Xaa at position 20 is Ile, Ala, Val, Leu, or Gly
  SITE (21)..(21): Xaa at position 21 is Cys, Ala, Val, Gly, Ser, or Thr
  SITE (22)..(22): Xaa at position 22 is Ile, Ala, Val, Leu, or Gly
  SITE (26)..(26): Xaa at position 26 is Ala, Gly, or Pro
  SITE (33)..(33): Xaa at position 33 is Val, Ala, Gly, Leu, or Ile
  SITE (36)..(36): Xaa at position 36 is Val, Ala, Gly, Leu, or Ile
  SITE (43)..(43): Xaa at position 43 is Val, Ala, Gly, Leu, or Ile
  SITE (49)..(49): Xaa at position 49 is Leu, Ala, Val, Gly, or Ile
  SITE (50)..(50): Xaa at position 50 is Leu, Ala, Val, Gly, or Ile
  SITE (58)..(58): Xaa at position 58 is Leu, Ala, Val, Gly, or Ile
  SITE (59)..(59): Xaa at position 59 is Cys, Ala, Val, Gly, Ser, or Thr
  SITE (61)..(61): Xaa at position 61 is Leu, Ala, Val, Gly, or Ile
  SITE (67)..(67): Xaa at position 67 is Leu, Ala, Val, Gly, or Ile
  SITE (69)..(69): Xaa at position 69 is Leu, Ala, Val, Gly, or Ile
  SITE (72)..(72): Xaa at position 72 is Cys, Ala, Val, Gly, Ser, or Thr
  SITE (74)..(74): Xaa at position 74 is Val, Ala, Gly, Leu, or Ile
  SITE (75)..(75): Xaa at position 75 is Ala, Gly, or Pro
  SITE (77)..(77): Xaa at position 77 is Trp, Tyr, Phe, Met, His, Ile, Leu Val, Ala, or Gly
  SITE (78)..(78): Xaa at position 78 is Ile, Ala, Val, Leu, or Gly
  SITE (79)..(79): Xaa at position 79 is Leu, Ala, Val, Gly, or Ile
  SITE (84)..(84): Xaa at position 84 is Cys, Ala, Val, Gly, Ser, or Thr
  SITE (87)..(87): Xaa at position 87 is Leu, Ala, Val, Gly, or Ile
  SITE (93)..(93): Xaa at position 93 is Trp, Tyr, Phe, Met, His, Ile, Leu Val, Ala, or Gly
  SITE (95)..(95): Xaa at position 95 is Tyr, Phe, Met, His, Ile, Leu, Val Ala, or Gly
  SITE (96)..(96): Xaa at position 96 is Ile, Ala, Val, Leu, or Gly
  SITE (97)..(97): Xaa at position 97 is Val, Ala, Gly, Leu, or Ile
  SITE (108)..(108): Xaa at position 108 is Tyr, Phe, Met, His, Ile, Leu, Val Ala, or Gly
  SITE (118)..(118): Xaa at position 118 is Leu, Ala, Val, Gly, or Ile
  SITE (122)..(122): Xaa at position 122 is Leu, Ala, Val, Gly, or Ile
  SITE (125)..(125): Xaa at position 125 is Val, Ala, Gly, Leu, or Ile
  SITE (128)..(128): Xaa at position 128 is Phe, Tyr, Met, His, Ile, Leu, Val Ala, or Gly
  SITE (134)..(134): Xaa at position 134 is Phe, Tyr, Met, His, Ile, Leu, Val Ala, or Gly
  SITE (150)..(150): Xaa at position 150 is Ala, Gly, or Pro
  SITE (152)..(152): Xaa at position 152 is Cys, Ala, Val, Gly, Ser, or Thr
  SITE (154)..(154): Xaa at position 154 is His, Phe, Tyr, Lys, Arg, Gly, Ser Thr, Ala, Val, Leu, Ile, Asn, Met, or Gln
  SITE (164)..(164): Xaa at position 164 is Leu, Ala, Val, Gly, or Ile
  SITE (165)..(165): Xaa at position 165 is Leu, Ala, Val, Gly, or Ile
  SITE (166)..(166): Xaa at position 166 is Trp, Tyr, Phe, Met, His, Ile, Leu Val, Ala, or Gly
  SITE (167)..(167): Xaa at position 167 is Leu, Ala, Val, Gly, or Ile
  SITE (173)..(173): Xaa at position 173 is Leu, Ala, Val, Gly, or Ile
  SITE (177)..(177): Xaa at position 177 is Leu, Ala, Val, Gly, or Ile
  SITE (189)..(189): Xaa at position 189 is Val, Ala, Gly, Leu, or Ile
  SITE (190)..(190): Xaa at position 190 is Leu, Ala, Val, Gly, or Ile
  SITE (191)..(191): Xaa at position 191 is Val, Ala, Gly, Leu, or Ile
  SITE (192)..(192): Xaa at position 192 is Leu, Ala, Val, Gly, or Ile
  SITE (193)..(193): Xaa at position 193 is Trp, Tyr, Phe, Met, His, Ile, Leu Val, Ala, or Gly
  SITE (195)..(195): Xaa at position 195 is Val, Ala, Gly, Leu, or Ile
  SITE (196)..(196): Xaa at position 196 is His, Phe, Tyr, Lys, Arg, Gly, Ser Thr, Ala, Val, Leu, Ile, Asn, Met, or Gln
  SITE (197)..(197): Xaa at position 197 is His, Phe, Tyr, Lys, Arg, Gly, Ser Thr, Ala, Val, Leu, Ile, Asn, Met, or Gln
  SITE (208)..(208): Xaa at position 208 is Tyr, Phe, Met, His, Ile, Leu, Val Ala, or Gly
  SITE (214)..(214): Xaa at position 214 is Tyr, Phe, Met, His, Ile, Leu, Val Ala, or Gly
  SITE (215)..(215): Xaa at position 215 is Val, Ala, Gly, Leu, or Ile
  SITE (217)..(217): Xaa at position 217 is Val, Ala, Gly, Leu, or Ile
  SITE (218)..(218): Xaa at position 218 is Val, Ala, Gly, Leu, or Ile
  SITE (243)..(243): Xaa at position 243 is Ile, Ala, Val, Leu, or Gly
  SITE (245)..(245): Xaa at position 245 is Tyr, Phe, Met, His, Ile, Leu, Val Ala, or Gly
  SITE (246)..(246): Xaa at position 246 is Tyr, Phe, Met, His, Ile, Leu, Val Ala, or Gly
  SITE (249)..(249): Xaa at position 249 is Leu, Ala, Val, Gly, or Ile
  SITE (250)..(250): Xaa at position 250 is Leu, Ala, Val, Gly, or Ile
  SITE (256)..(256): Xaa at position 256 is Ile, Ala, Val, Leu, or Gly
  SITE (258)..(258): Xaa at position 258 is Phe, Tyr, Met, His, Ile, Leu, Val Ala, or Gly
  SITE (260)..(260): Xaa at position 260 is Ala, Gly, or Pro
  SITE (264)..(264): Xaa at position 264 is Leu, Ala, Val, Gly, or Ile
  SITE (265)..(265): Xaa at position 265 is Ile, Ala, Val, Leu, or Gly
  SITE (266)..(266): Xaa at position 266 is Ala, Gly, or Pro
  SITE (269)..(269): Xaa at position 269 is Tyr, Phe, Met, His, Ile, Leu, Val Ala, or Gly
  SITE (270)..(270): Xaa at position 270 is Ala, Gly, or Pro
  SITE (271)..(271): Xaa at position 271 is Phe, Tyr, Met, His, Ile, Leu, Val Ala, or Gly
  SITE (272)..(272): Xaa at position 272 is Ala, Gly, or Pro
  SITE (273)..(273): Xaa at position 273 is Leu, Ala, Val, Gly, or Ile
  SITE (277)..(277): Xaa at position 277 is Phe, Tyr, Met, His, Ile, Leu, Val Ala, or Gly
  SITE (281)..(281): Xaa at position 281 is Ile, Ala, Val, Leu, or Gly
  SITE (282)..(282): Xaa at position 282 is Ile, Ala, Val, Leu, or Gly
  SITE (291)..(291): Xaa at position 291 is Cys, Ala, Val, Gly, Ser, or Thr
  SITE (295)..(295): Xaa at position 295 is Cys, Ala, Val, Gly, Ser, or Thr
  SITE (301)..(301): Xaa at position 301 is Ala, Gly, or Pro
  SITE (302)..(302): Xaa at position 302 is Ile, Ala, Val, Leu, or Gly
  SITE (312)..(312): Xaa at position 312 is His, Phe, Tyr, Lys, Arg, Gly, Ser Thr, Ala, Val, Leu, Ile, Asn, Met, or Gln
  SITE (316)..(316): Xaa at position 316 is Ile, Ala, Val, Leu, or Gly
  SITE (323)..(323): Xaa at position 323 is Val, Ala, Gly, Leu, or Ile
  SITE (328)..(328): Xaa at position 328 is Leu, Ala, Val, Gly, or Ile
  SITE (330)..(330): Xaa at position 330 is Met, Ile, Leu, Val, Ala, or Gly
  SITE (331)..(331): Xaa at position 331 is Val, Ala, Gly, Leu, or Ile
  SITE (348)..(348): Xaa at position 348 is Ala, Gly, or Pro
  SITE (360)..(360): Xaa at position 360 is Met, Ile, Leu, Val, Ala, or Gly
  SITE (365)..(365): Xaa at position 365 is Tyr, Phe, Met, His, Ile, Leu, Val Ala, or Gly
  SITE (387)..(387): Xaa at position 387 is Ala, Gly, or Pro
  SITE (388)..(388): Xaa at position 388 is Ile, Ala, Val, Leu, or Gly
  SITE (439)..(439): Xaa at position 439 is Ala, Gly, or Pro
  SITE (451)..(451): Xaa at position 451 is Leu, Ala, Val, Gly, or Ile
  SITE (458)..(458): Xaa at position 458 is Val, Ala, Gly, Leu, or Ile
  SITE (461)..(461): Xaa at position 461 is Leu, Ala, Val, Gly, or Ile
  SITE (465)..(465): Xaa at position 465 is Val, Ala, Gly, Leu, or Ile
  SITE (469)..(469): Xaa at position 469 is Leu, Ala, Val, Gly, or Ile
  SITE (480)..(480): Xaa at position 480 is Cys, Ala, Val, Gly, Ser, or Thr
  SITE (485)..(485): Xaa at position 485 is His, Phe, Tyr, Lys, Arg, Gly, Ser Thr, Ala, Val, Leu, Ile, Asn, Met, or Gln
  SITE (487)..(487): Xaa at position 487 is Cys, Ala, Val, Gly, Ser, or Thr
  SITE (491)..(491): Xaa at position 491 is Cys, Ala, Val, Gly, Ser, or Thr
  SITE (492)..(492): Xaa at position 492 is Met, Ile, Leu, Val, Ala, or Gly
MKAKLLXLLCTFTATYADTXXXGYHXNNSTDTXDTXLEKNVTXTHSVNXXEDSHNGKXXLXKGIAPXQXGNXSXXGXXXGNPEXESXISKESXSXXXETPNPENGTCXPGYFADYEEXREQXSSXSSXERFEIXPKESSWPNHTVTGVSXSXSXNGKSSFYRNXXXXTEKNGXYPNXSKSYVNNKEKEXXXXXGXXXPSNIGVQRAIXHTENAXXSXXSSHYSRRFTPEIAKRPKVRDQEGRXNXXWTXXEPGDTXIXEXNGNXXXPWXXXXXSRGXESGXXTSNAPMNEXDAKXQTPQGXXNSSLPFQNVXPVTXGECPKYXRSAKXRXXTGLRNIPSIQSRGLFGXIAGFIEGGWTGXIDGWXGYHHQNEQGSGYAADQKSTQNXXNGITNKVNSVIEKMNTQFTAVGKEFNKLERRMENLNKKVDDGFLDIWTYNXELLVLLENERTXDFHDSNXKNXYEKXKSQXKNNAKEIGNGXFEFYXKXNNEXXESVKNGTYDYPKYSEESKLNREKIDGVKLESMGVYQILAIYSTVASSLVLLVSLGAISFWMCSNGSLQCRICI

SEQ ID NO: 650 - protein, 728 aa, Mus musculus
  SITE (43)..(43): Xaa at position 43 is Phe, Tyr, Met, His, Ile, Leu, Val Ala, or Gly
  SITE (71)..(71): Xaa at position 71 is Cys, Ala, Val, Gly, Ser, or Thr
  SITE (72)..(72): Xaa at position 72 is Ala, Gly, or Pro
  SITE (75)..(75): Xaa at position 75 is Cys, Ala, Val, Gly, Ser, or Thr
  SITE (85)..(85): Xaa at position 85 is Cys, Ala, Val, Gly, Ser, or Thr
  SITE (87)..(87): Xaa at position 87 is Ala, Gly, or Pro
  SITE (88)..(88): Xaa at position 88 is Phe, Tyr, Met, His, Ile, Leu, Val Ala, or Gly
  SITE (89)..(89): Xaa at position 89 is Val, Ala, Gly, Leu, or Ile
  SITE (97)..(97): Xaa at position 97 is Cys, Ala, Val, Gly, Ser, or Thr
  SITE (99)..(99): Xaa at position 99 is Trp, Tyr, Phe, Met, His, Ile, Leu Val, Ala, or Gly
  SITE (119)..(119): Xaa at position 119 is Leu, Ala, Val, Gly, or Ile
  SITE (153)..(153): Xaa at position 153 is Trp, Tyr, Phe, Met, His, Ile, Leu Val, Ala, or Gly
  SITE (178)..(178): Xaa at position 178 is Cys, Ala, Val, Gly, Ser, or Thr
  SITE (190)..(190): Xaa at position 190 is Cys, Ala, Val, Gly, Ser, or Thr
  SITE (191)..(191): Xaa at position 191 is Phe, Tyr, Met, His, Ile, Leu, Val Ala, or Gly
  SITE (207)..(207): Xaa at position 207 is Cys, Ala, Val, Gly, Ser, or Thr
  SITE (233)..(233): Xaa at position 233 is Cys, Ala, Val, Gly, Ser, or Thr
  SITE (236)..(236): Xaa at position 236 is Trp, Tyr, Phe, Met, His, Ile, Leu Val, Ala, or Gly
  SITE (261)..(261): Xaa at position 261 is Cys, Ala, Val, Gly, Ser, or Thr
  SITE (272)..(272): Xaa at position 272 is Cys, Ala, Val, Gly, Ser, or Thr
  SITE (284)..(284): Xaa at position 284 is Cys, Ala, Val, Gly, Ser, or Thr
MMWGTKLLPVLLLQHVLLHLLLLHVAIPYAEGQKKRRNTLHEXKKSAKTTLTKEDPLLKIKTKKVNSADEXXNRXIRNRGFTFTXKXXXFDKSRKRXYXYPFNSMSSGVKKGFGHEFDXYENKDYIRNCIIGKGGSYKGTVSITKSGIKCQPXNSMIPHEHSFLPSSYRGKDLQENYXRNPRGEEGGPWXXTSNPEVRYEVCDIPQXSEVECMTCNGESYRGPMDHTESGKTXQRXDQQTPHRHKFLPERYPDKGFDDNYXRNPDGKPRPWXYTLDPDTPWEYXAIKTCAHSAVNETDVPMETTECIQGQGEGYRGTSNTIWNGIPCQRWDSQYPHKHDITPENFKCKDLRENYCRNPDGAESPWCFTTDPNIRVGYCSQIPKCDVSSGQDCYRGNGKNYMGNLSKTRSGLTCSMWDKNMEDLHRHIFWEPDASKLNKNYCRNPDDDAHGPWCYTGNPLIPWDYCPISRCEGDTTPTIVNLDHPVISCAKTKQLRVVNGIPTQTTVGWMVSLKYRNKHICGGSLIKESWVLTARQCFPARNKDLKDYEAWLGIHDVHERGEEKRKQILNISQLVYGPEGSDLVLLKLARPAILDNFVSTIDLPSYGCTIPEKTTCSIYGWGYTGLINADGLLRVAHLYIMGNEKCSQHHQGKVTLNESELCAGAEKIGSGPCEGDYGGPLICEQHKMRMVLGVIVPGRGCAIPNRPGIFVRVAYYAKWIHKVILTYKL

SEQ ID NO: 651 - protein, 325 aa, Homo sapiens
  SITE (38)..(38): Xaa at position 38 is Leu, Ala, Val, Gly, or Ile
  SITE (54)..(54): Xaa at position 54 is Ala, Gly, or Pro
  SITE (57)..(57): Xaa at position 57 is Leu, Ala, Val, Gly, or Ile
  SITE (74)..(74): Xaa at position 74 is Cys, Ala, Val, Gly, Ser, or Thr
  SITE (76)..(76): Xaa at position 76 is Phe, Tyr, Met, His, Ile, Leu, Val Ala, or Gly
  SITE (87)..(87): Xaa at position 87 is Leu, Ala, Val, Gly, or Ile
  SITE (89)..(89): Xaa at position 89 is Val, Ala, Gly, Leu, or Ile
  SITE (91)..(91): Xaa at position 91 is Ala, Gly, or Pro
  SITE (108)..(108): Xaa at position 108 is Val, Ala, Gly, Leu, or Ile
  SITE (127)..(127): Xaa at position 127 is Leu, Ala, Val, Gly, or Ile
  SITE (145)..(145): Xaa at position 145 is Met, Ile, Leu, Val, Ala, or Gly
  SITE (156)..(156): Xaa at position 156 is Val, Ala, Gly, Leu, or Ile
  SITE (189)..(189): Xaa at position 189 is Val, Ala, Gly, Leu, or Ile
  SITE (191)..(191): Xaa at position 191 is Val, Ala, Gly, Leu, or Ile
  SITE (195)..(195): Xaa at position 195 is Leu, Ala, Val, Gly, or Ile
  SITE (208)..(208): Xaa at position 208 is Val, Ala, Gly, Leu, or Ile
MAWSLGSWLGGCLLVSALGMVPPPENVRMNSVNFKNIXQWESPAFAKGNLTFTXQYXSYRIFQDKCMNTTLTEXDXSSLSKYGDHTXRXRXEFADEHSDWVNITFCPXDDTIIGPPGMQVEVLADSXHMRFLAPKIENEYETWTXKNVYNSWTYNXQYWKNGTDEKFQITPQYDFEVLRNLEPWTTYCXQXRGFXPDRNKAGEWSEPXCEQTTHDETVPSWMVAVILMASVFMVCLALLGCFALLWCVYKKTKYAFSPRNSLPQHLKEFLGHPHHNTLLFFSFPLSDENDVFDKLSVIAEDSESGKQNPGDSCSLGTPPGQGPQS

SEQ ID NO: 652 - protein, 913 aa, Homo sapiens
  SITE (37)..(37): Xaa at position 37 is Met, Ile, Leu, Val, Ala, or Gly
  SITE (72)..(72): Xaa at position 72 is Ala, Gly, or Pro
  SITE (73)..(73): Xaa at position 73 is Trp, Tyr, Phe, Met, His, Ile, Leu Val, Ala, or Gly
  SITE (87)..(87): Xaa at position 87 is Leu, Ala, Val, Gly, or Ile
  SITE (89)..(89): Xaa at position 89 is Val, Ala, Gly, Leu, or Ile
  SITE (97)..(97): Xaa at position 97 is Val, Ala, Gly, Leu, or Ile
  SITE (100)..(100): Xaa at position 100 is Val, Ala, Gly, Leu, or Ile
  SITE (141)..(141): Xaa at position 141 is Ile, Ala, Val, Leu, or Gly
  SITE (159)..(159): Xaa at position 159 is Met, Ile, Leu, Val, Ala, or Gly
  SITE (161)..(161): Xaa at position 161 is Ala, Gly, or Pro
  SITE (164)..(164): Xaa at position 164 is Val, Ala, Gly, Leu, or Ile
  SITE (166)..(166): Xaa at position 166 is Phe, Tyr, Met, His, Ile, Leu, Val Ala, or Gly
  SITE (178)..(178): Xaa at position 178 is Leu, Ala, Val, Gly, or Ile
  SITE (180)..(180): Xaa at position 180 is Val, Ala, Gly, Leu, or Ile
  SITE (182)..(182): Xaa at position 182 is Leu, Ala, Val, Gly, or Ile
  SITE (191)..(191): Xaa at position 191 is Leu, Ala, Val, Gly, or Ile
  SITE (194)..(194): Xaa at position 194 is Tyr, Phe, Met, His, Ile, Leu, Val Ala, or Gly
  SITE (196)..(196): Xaa at position 196 is Ala, Gly, or Pro
  SITE (208)..(208): Xaa at position 208 is Val, Ala, Gly, Leu, or Ile
  SITE (210)..(210): Xaa at position 210 is Leu, Ala, Val, Gly, or Ile
  SITE (231)..(231): Xaa at position 231 is Leu, Ala, Val, Gly, or Ile
  SITE (241)..(241): Xaa at position 241 is Phe, Tyr, Met, His, Ile, Leu, Val Ala, or Gly
  SITE (255)..(255): Xaa at position 255 is Tyr, Phe, Met, His, Ile, Leu, Val Ala, or Gly
  SITE (256)..(256): Xaa at position 256 is Val, Ala, Gly, Leu, or Ile
  SITE (258)..(258): Xaa at position 258 is Trp, Tyr, Phe, Met, His, Ile, Leu Val, Ala, or Gly
  SITE (268)..(268): Xaa at position 268 is Val, Ala, Gly, Leu, or Ile
  SITE (270)..(270): Xaa at position 270 is Met, Ile, Leu, Val, Ala, or Gly
  SITE (274)..(274): Xaa at position 274 is Phe, Tyr, Met, His, Ile, Leu, Val Ala, or Gly
  SITE (280)..(280): Xaa at position 280 is Phe, Tyr, Met, His, Ile, Leu, Val Ala, or Gly
  SITE (283)..(283): Xaa at position 283 is Met, Ile, Leu, Val, Ala, or Gly
  SITE (285)..(285): Xaa at position 285 is Val, Ala, Gly, Leu, or Ile
  SITE (287)..(287): Xaa at position 287 is Cys, Ala, Val, Gly, Ser, or Thr
  SITE (295)..(295): Xaa at position 295 is Ala, Gly, or Pro
  SITE (301)..(301): Xaa at position 301 is Val, Ala, Gly, Leu, or Ile
  SITE (303)..(303): Xaa at position 303 is Cys, Ala, Val, Gly, Ser, or Thr
  SITE (305)..(305): Xaa at position 305 is Phe, Tyr, Met, His, Ile, Leu, Val Ala, or Gly
  SITE (336)..(336): Xaa at position 336 is Val, Ala, Gly, Leu, or Ile
  SITE (338)..(338): Xaa at position 338 is Leu, Ala, Val, Gly, or Ile
  SITE (343)..(343): Xaa at position 343 is Ala, Gly, or Pro
  SITE (346)..(346): Xaa at position 346 is Leu, Ala, Val, Gly, or Ile
  SITE (348)..(348): Xaa at position 348 is Cys, Ala, Val, Gly, Ser, or Thr
  SITE (350)..(350): Xaa at position 350 is Phe, Tyr, Met, His, Ile, Leu, Val Ala, or Gly
  SITE (357)..(357): Xaa at position 357 is Leu, Ala, Val, Gly, or Ile
  SITE (358)..(358): Xaa at position 358 is Leu, Ala, Val, Gly, or Ile
  SITE (359)..(359): Xaa at position 359 is Phe, Tyr, Met, His, Ile, Leu, Val Ala, or Gly
MGPEALSSLLLLLLVASGDADMKGHFDPAKCRYALGXQDRTIPDSDISASSSWSDSTAARHSRLESSDGDGXXCPAGSVFPKEEEYXQXDLQRLHLXALXGTQGRHAGGLGKEFSRSYRLRYSRDGRRWMGWKDRWGQEVXSGNEDPEGVVLKDLGPPXVXRLXRXYPRADRVMSVCXRXEXYGCLWRDGXLSXTXPVGQTMYLSEAXYXNDSTYDGHTVGGLQYGGLGQXADGVVGLDDXRKSQELRVWPGYDXXGXSNHSFSSGYXEXEFEXDRLRAXQAXQXHXNNMHTLGXRLPGGXEXRXRRGPAMAWEGEPMRHNLGGNLGDPRARAVSXPXGGRVXRFXQXRXLFAGPWXXXSEISFISDVVNNSSPALGGTFPPAPWWPPGPPPTNFSSLELEPRGQQPVAKAEGSPTAILIGCLVAIILLLLLIIALMLWRLHWRRLLSKAERRVLEEELTVHLSVPGDTILINNRPGPREPPPYQEPRPRGNPPHSAPCVPNGSALLLSNPAYRLLLATYARPPRGPGPPTPAWAKPTNTQAYSGDYMEPEKPGAPLLPPPPQNSVPHYAEADIVTLQGVTGGNTYAVPALPPGAVGDGPPRVDFPRSRLRFKEKLGEGQFGEVHLCEVDSPQDLVSLDFPLNVRKGHPLLVAVKILRPDATKNARNDFLKEVKIMSRLKDPNIIRLLGVCVQDDPLCMITDYMENGDLNQFLSAHQLEDKAAEGAPGDGQAAQGPTISYPMLLHVAAQIASGMRYLATLNFVHRDLATRNCLVGENFTIKIADFGMSRNLYAGDYYRVQGRAVLPIRWMAWECILMGKFTTASDVWAFGVTLWEVLMLCRAQPFGQLTDEQVIENAGEFFRDQGRQVYLSRPPACPQGLYELMLRCWSRESEQRPPFSQLHRFLAEDALNTV

SEQ ID NO: 653 - protein, 620 aa, Homo sapiens
  SITE (358)..(358): Xaa at position 358 is Ile, Ala, Val, Leu, or Gly
  SITE (388)..(388): Xaa at position 388 is Val, Ala, Gly, Leu, or Ile
  SITE (390)..(390): Xaa at position 390 is Ile, Ala, Val, Leu, or Gly
  SITE (393)..(393): Xaa at position 393 is Ile, Ala, Val, Leu, or Gly
  SITE (397)..(397): Xaa at position 397 is Ala, Gly, or Pro
  SITE (403)..(403): Xaa at position 403 is Phe, Tyr, Met, His, Ile, Leu, Val Ala, or Gly
  SITE (407)..(407): Xaa at position 407 is Ala, Gly, or Pro
  SITE (418)..(418): Xaa at position 418 is Leu, Ala, Val, Gly, or Ile
  SITE (419)..(419): Xaa at position 419 is Val, Ala, Gly, Leu, or Ile
  SITE (424)..(424): Xaa at position 424 is Val, Ala, Gly, Leu, or Ile
  SITE (432)..(432): Xaa at position 432 is Cys, Ala, Val, Gly, Ser, or Thr
  SITE (434)..(434): Xaa at position 434 is Val, Ala, Gly, Leu, or Ile
  SITE (443)..(443): Xaa at position 443 is Leu, Ala, Val, Gly, or Ile
  SITE (447)..(447): Xaa at position 447 is Leu, Ala, Val, Gly, or Ile
  SITE (459)..(459): Xaa at position 459 is Leu, Ala, Val, Gly, or Ile
  SITE (462)..(462): Xaa at position 462 is Met, Ile, Leu, Val, Ala, or Gly
  SITE (463)..(463): Xaa at position 463 is Cys, Ala, Val, Gly, Ser, or Thr
  SITE (466)..(466): Xaa at position 466 is Val, Ala, Gly, Leu, or Ile
  SITE (467)..(467): Xaa at position 467 is Cys, Ala, Val, Gly, Ser, or Thr
  SITE (470)..(470): Xaa at position 470 is Met, Ile, Leu, Val, Ala, or Gly
  SITE (473)..(473): Xaa at position 473 is Leu, Ala, Val, Gly, or Ile
  SITE (480)..(480): Xaa at position 480 is His, Phe, Tyr, Lys, Arg, Gly, Ser Thr, Ala, Val, Leu, Ile, Asn, Met, or Gln
  SITE (483)..(483): Xaa at position 483 is Leu, Ala, Val, Gly, or Ile
  SITE (484)..(484): Xaa at position 484 is Ala, Gly, or Pro
  SITE (485)..(485): Xaa at position 485 is Ala, Gly, or Pro
  SITE (488)..(488): Xaa at position 488 is Cys, Ala, Val, Gly, Ser, or Thr
  SITE (490)..(490): Xaa at position 490 is Val, Ala, Gly, Leu, or Ile
  SITE (496)..(496): Xaa at position 496 is Ile, Ala, Val, Leu, or Gly
  SITE (498)..(498): Xaa at position 498 is Val, Ala, Gly, Leu, or Ile
  SITE (501)..(501): Xaa at position 501 is Phe, Tyr, Met, His, Ile, Leu, Val Ala, or Gly
  SITE (522)..(522): Xaa at position 522 is Val, Ala, Gly, Leu, or Ile
  SITE (541)..(541): Xaa at position 541 is Val, Ala, Gly, Leu, or Ile
  SITE (542)..(542): Xaa at position 542 is Trp, Tyr, Phe, Met, His, Ile, Leu Val, Ala, or Gly
  SITE (544)..(544): Xaa at position 544 is Phe, Tyr, Met, His, Ile, Leu, Val Ala, or Gly
  SITE (546)..(546): Xaa at position 546 is Val, Ala, Gly, Leu, or Ile
  SITE (547)..(547): Xaa at position 547 is Leu, Ala, Val, Gly, or Ile
  SITE (548)..(548): Xaa at position 548 is Met, Ile, Leu, Val, Ala, or Gly
  SITE (549)..(549): Xaa at position 549 is Trp, Tyr, Phe, Met, His, Ile, Leu Val, Ala, or Gly
  SITE (551)..(551): Xaa at position 551 is Val, Ala, Gly, Leu, or Ile
  SITE (567)..(567): Xaa at position 567 is Val, Ala, Gly, Leu, or Ile
  SITE (571)..(571): Xaa at position 571 is Ile, Ala, Val, Leu, or Gly
  SITE (583)..(583): Xaa at position 583 is Ala, Gly, or Pro
  SITE (590)..(590): Xaa at position 590 is Ile, Ala, Val, Leu, or Gly
  SITE (591)..(591): Xaa at position 591 is Met, Ile, Leu, Val, Ala, or Gly
  SITE (594)..(594): Xaa at position 594 is Cys, Ala, Val, Gly, Ser, or Thr
  SITE (595)..(595): Xaa at position 595 is Trp, Tyr, Phe, Met, His, Ile, Leu Val, Ala, or Gly
  SITE (605)..(605): Xaa at position 605 is Phe, Tyr, Met, His, Ile, Leu, Val Ala, or Gly
  SITE (608)..(608): Xaa at position 608 is Leu, Ala, Val, Gly, or Ile
  SITE (612)..(612): Xaa at position 612 is Leu, Ala, Val, Gly, or Ile
MNNFILLEEQLIKKSQQKRRTSPSNFKVRFFVLTKASLAYFEDRHGKKRTLKGSIELSRIKCVEIVKSDISIPCHYKYPFQVVHDNYLLYVFAPDRESRQRWVLALKEETRNNNSLVPKYHPNFWMDGKWRCCSQLEKLATGCAQYDPTKNASKKPLPPTPEDNRRPLWEPEETVVIALYDYQTNDPQELALRRNEEYCLLDSSEIHWWRVQDRNGHEGYVPSSYLVEKSPNNLETYEWYNKSISRDKAEKLLLDTGKEGAFMVRDSRTAGTYTVSVFTKAVVSENNPCIKHYHIKETNDNPKRYYVAEKYVFDSIPLLINYHQHNGGGLVTRLRYPVCFGRQKAPVTAGLRYGKWVXDPSELTFVQEIGSGQFGLVHLGYWLNKDKXAXKTXREGXMSEEDXIEEXEVMMKLSHPKXXQLYGXCLEQAPIXLXFEFMEHGCXSDYXRTQRGLFAAETXLGXXLDXXEGXAYXEEACVIXRDXXXRNXLXGENQVXKXSDXGMTRFVLDDQYTSSTGTKFPXKWASPEVFSFSRYSSKSDXXSXGXXXXEXFSEGKIPYENRSNSEXVEDXSTGFRLYKPRLXSTHVYQXXNHXXKERPEDRPAXSRXLRQXAEIAESGL

SEQ ID NO: 654 - protein, 1581 aa, Homo sapiens
  SITE (701)..(701): Xaa at position 701 is Ile, Ala, Val, Leu, or Gly
  SITE (703)..(703): Xaa at position 703 is Ile, Ala, Val, Leu, or Gly
  SITE (708)..(708): Xaa at position 708 is Leu, Ala, Val, Gly, or Ile
  SITE (710)..(710): Xaa at position 710 is Met, Ile, Leu, Val, Ala, or Gly
  SITE (711)..(711): Xaa at position 711 is Ile, Ala, Val, Leu, or Gly
  SITE (712)..(712): Xaa at position 712 is Val, Ala, Gly, Leu, or Ile
  SITE (717)..(717): Xaa at position 717 is Cys, Ala, Val, Gly, Ser, or Thr
  SITE (722)..(722): Xaa at position 722 is Leu, Ala, Val, Gly, or Ile
  SITE (723)..(723): Xaa at position 723 is Leu, Ala, Val, Gly, or Ile
MPLAFCGSENHSAAYRVDQGVLNNGCFVDALNVVPHVFLLFITFPILFIGWGSQSSKVHIHHSTWLHFPGHNLRWILTFMLLFVLVCEIAEGILSDGVTESHHLHLYMPAGMAFMAAVTSVVYYHNIETSNFPKLLIALLVYWTLAFITKTIKFVKFLDHAIGFSQLRFCLTGLLVILYGMLLLVEVNVIRVRRYIFFKTPREVKPPEDLQDLGVRFLQPFVNLLSKGTYWWMNAFIKTAHKKPIDLRAIGKLPIAMRALTNYQRLCEAFDAQVRKDIQGTQGARAIWQALSHAFGRRLVLSSTFRILADLLGFAGPLCIFGIVDHLGKENDVFQPKTQFLGVYFVSSQEFLANAYVLAVLLFLALLLQRTFLQASYYVAIETGINLRGAIQTKIYNKIMHLSTSNLSMGEMTAGQICNLVAIDTNQLMWFFFLCPNLWAMPVQIIVGVILLYYILGVSALIGAAVIILLAPVQYFVATKLSQAQRSTLEYSNERLKQTNEMLRGIKLLKLYAWENIFRTRVETTRRKEMTSLRAFAIYTSISIFMNTAIPIAAVLITFVGHVSFFKEADFSPSVAFASLSLFHILVTPLFLLSSVVRSTVKALVSVQKLSEFLSSAEIREEQCAPHEPTPQGPASKYQAVPLRVVNRKRPAREDCRGLTGPLQSLVPSADGDADNCCVQIMGGYFTWTPDGIPTLSNITXRXPRGQXTXXXGQVGXGKSSXXLAALGEMQKVSGAVFWSSLPDSEIGEDPSPERETATDLDIRKRGPVAYASQKPWLLNATVEENIIFESPFNKQRYKMVIEACSLQPDIDILPHGDQTQIGERGINLSGGQRQRISVARALYQHANVVFLDDPFSALDIHLSDHLMQAGILELLRDDKRTVVLVTHKLQYLPHADWIIAMKDGTIQREGTLKDFQRSECQLFEHWKTLMNRQDQELEKETVTERKATEPPQGLSRAMSSRDGLLQDEEEEEEEAAESEEDDNLSSMLHQRAEIPWRACAKYLSSAGILLLSLLVFSQLLKHMVLVAIDYWLAKWTDSALTLTPAARNCSLSQECTLDQTVYAMVFTVLCSLGIVLCLVTSVTVEWTGLKVAKRLHRSLLNRIILAPMRFFETTPLGSILNRFSSDCNTIDQHIPSTLECLSRSTLLCVSALAVISYVTPVFLVALLPLAIVCYFIQKYFRVASRDLQQLDDTTQLPLLSHFAETVEGLTTIRAFRYEARFQQKLLEYTDSNNIASLFLTAANRWLEVRMEYIGACVVLIAAVTSISNSLHRELSAGLVGLGLTYALMVSNYLNWMVRNLADMELQLGAVKRIHGLLKTEAESYEGLLAPSLIPKNWPDQGKIQIQNLSVRYDSSLKPVLKHVNALIAPGQKIGICGRTGSGKSSFSLAFFRMVDTFEGHIIIDGIDIAKLPLHTLRSRLSIILQDPVLFSGTIRFNLDPERKCSDSTLWEALEIAQLKLVVKALPGGLDAIITEGGENFSQGQRQLFCLARAFVRKTSIFIMDEATASIDMATENILQKVVMTAFADRTVVTIAHRVHTILSADLVIVLKRGAILEFDKPEKLLSRKDSVFASFVRADK

SEQ ID NO: 655 - protein, 495 aa, Homo sapiens
  SITE (347)..(347): Xaa at position 347 is Ala, Gly, or Pro
MTVMSGENVDEASAAPGHPQDGSYPRQADHDDHECCERVVINISGLRFETQLKTLAQFPNTLLGNPKKRMRYFDPLRNEYFFDRNRPSFDAILYYYQSGGRLRRPVNVPLDMFSEEIKFYELGEEAMEKFREDEGFIKEEERPLPEKEYQRQVWLLFEYPESSGPARVIAIVSVMVILISIVIFCLETLPELKDDKDFTGTVHRIDNTTVIYNSNIFTDPFFIVETLCIIWFSFELVVRFFACPSKTDFFKNIMNFIDIVAIIPYFITLGTEIAEQEGNQKGEQATSLAILRVIRLVRVFRIFKLSRHSKGLQILGQTLKASMRELGLLIFFLFIGVILFSSAVYFXEAEEAESHFSSIPDAFWWAVVSMTTVGYGDMYPVTIGGKIVGSLCAIAGVLTIALPVPVIVSNFNYFYHRETEGEEQAQLLHVSSPNLASDSDLSRRSSSTMSKSEYMEIEEDMNNSIAHYRQVNIRTANCTTANQNCVNKSKLLTDV

SEQ ID NO: 656 - protein, 471 aa, Influenza A virus
  strain A/Chicken/Victoria/1/1985 H7N7
  SITE (86)..(86): Xaa at position 86 is Leu, Ala, Val, Gly, or Ile
  SITE (93)..(93): Xaa at position 93 is Val, Ala, Gly, Leu, or Ile
  SITE (104)..(104): Xaa at position 104 is Ala, Gly, or Pro
  SITE (105)..(105): Xaa at position 105 is Ile, Ala, Val, Leu, or Gly
  SITE (113)..(113): Xaa at position 113 is Ile, Ala, Val, Leu, or Gly
  SITE (115)..(115): Xaa at position 115 is Val, Ala, Gly, Leu, or Ile
  SITE (120)..(120): Xaa at position 120 is Tyr, Phe, Met, His, Ile, Leu, Val Ala, or Gly
  SITE (121)..(121): Xaa at position 121 is Val, Ala, Gly, Leu, or Ile
  SITE (123)..(123): Xaa at position 123 is Cys, Ala, Val, Gly, Ser, or Thr
  SITE (130)..(130): Xaa at position 130 is Met, Ile, Leu, Val, Ala, or Gly
  SITE (131)..(131): Xaa at position 131 is Tyr, Phe, Met, His, Ile, Leu, Val Ala, or Gly
  SITE (132)..(132): Xaa at position 132 is Ala, Gly, or Pro
  SITE (133)..(133): Xaa at position 133 is Leu, Ala, Val, Gly, or Ile
  SITE (157)..(157): Xaa at position 157 is Leu, Ala, Val, Gly, or Ile
  SITE (158)..(158): Xaa at position 158 is Ile, Ala, Val, Leu, or Gly
  SITE (175)..(175): Xaa at position 175 is Cys, Ala, Val, Gly, Ser, or Thr
  SITE (176)..(176): Xaa at position 176 is Val, Ala, Gly, Leu, or Ile
  SITE (183)..(183): Xaa at position 183 is Cys, Ala, Val, Gly, Ser, or Thr
  SITE (190)..(190): Xaa at position 190 is Met, Ile, Leu, Val, Ala, or Gly
  SITE (192)..(192): Xaa at position 192 is Ile, Ala, Val, Leu, or Gly
  SITE (193)..(193): Xaa at position 193 is Cys, Ala, Val, Gly, Ser, or Thr
  SITE (194)..(194): Xaa at position 194 is Val, Ala, Gly, Leu, or Ile
  SITE (201)..(201): Xaa at position 201 is Ala, Gly, or Pro
  SITE (203)..(203): Xaa at position 203 is Ala, Gly, or Pro
  SITE (205)..(205): Xaa at position 205 is Val, Ala, Gly, Leu, or Ile
  SITE (207)..(207): Xaa at position 207 is Tyr, Phe, Met, His, Ile, Leu, Val Ala, or Gly
  SITE (219)..(219): Xaa at position 219 is Ala, Gly, or Pro
  SITE (223)..(223): Xaa at position 223 is Leu, Ala, Val, Gly, or Ile
  SITE (230)..(230): Xaa at position 230 is Cys, Ala, Val, Gly, Ser, or Thr
  SITE (231)..(231): Xaa at position 231 is Val, Ala, Gly, Leu, or Ile
  SITE (232)..(232): Xaa at position 232 is Cys, Ala, Val, Gly, Ser, or Thr
  SITE (238)..(238): Xaa at position 238 is Ala, Gly, or Pro
  SITE (239)..(239): Xaa at position 239 is Val, Ala, Gly, Leu, or Ile
  SITE (240)..(240): Xaa at position 240 is Val, Ala, Gly, Leu, or Ile
  SITE (241)..(241): Xaa at position 241 is Met, Ile, Leu, Val, Ala, or Gly
  SITE (254)..(254): Xaa at position 254 is Val, Ala, Gly, Leu, or Ile
  SITE (255)..(255): Xaa at position 255 is Met, Ile, Leu, Val, Ala, or Gly
  SITE (256)..(256): Xaa at position 256 is Tyr, Phe, Met, His, Ile, Leu, Val Ala, or Gly
  SITE (257)..(257): Xaa at position 257 is Phe, Tyr, Met, His, Ile, Leu, Val Ala, or Gly
  SITE (275)..(275): Xaa at position 275 is Ile, Ala, Val, Leu, or Gly
  SITE (278)..(278): Xaa at position 278 is Cys, Ala, Val, Gly, Ser, or Thr
  SITE (280)..(280): Xaa at position 280 is Cys, Ala, Val, Gly, Ser, or Thr
  SITE (281)..(281): Xaa at position 281 is Tyr, Phe, Met, His, Ile, Leu, Val Ala, or Gly
  SITE (287)..(287): Xaa at position 287 is Ile, Ala, Val, Leu, or Gly
  SITE (289)..(289): Xaa at position 289 is Cys, Ala, Val, Gly, Ser, or Thr
  SITE (290)..(290): Xaa at position 290 is Val, Ala, Gly, Leu, or Ile
  SITE (291)..(291): Xaa at position 291 is Cys, Ala, Val, Gly, Ser, or Thr
  SITE (298)..(298): Xaa at position 298 is Ala, Gly, or Pro
  SITE (302)..(302): Xaa at position 302 is Ile, Ala, Val, Leu, or Gly
  SITE (303)..(303): Xaa at position 303 is Ile, Ala, Val, Leu, or Gly
  SITE (305)..(305): Xaa at position 305 is Ile, Ala, Val, Leu, or Gly
  SITE (316)..(316): Xaa at position 316 is Tyr, Phe, Met, His, Ile, Leu, Val Ala, or Gly
  SITE (317)..(317): Xaa at position 317 is Val, Ala, Gly, Leu, or Ile
  SITE (318)..(318): Xaa at position 318 is Cys, Ala, Val, Gly, Ser, or Thr
  SITE (321)..(321): Xaa at position 321 is Val, Ala, Gly, Leu, or Ile
  SITE (322)..(322): Xaa at position 322 is Leu, Ala, Val, Gly, or Ile
  SITE (349)..(349): Xaa at position 349 is Val, Ala, Gly, Leu, or Ile
  SITE (352)..(352): Xaa at position 352 is Phe, Tyr, Met, His, Ile, Leu, Val Ala, or Gly
  SITE (354)..(354): Xaa at position 354 is Phe, Tyr, Met, His, Ile, Leu, Val Ala, or Gly
  SITE (361)..(361): Xaa at position 361 is Trp, Tyr, Phe, Met, His, Ile, Leu Val, Ala, or Gly
  SITE (362)..(362): Xaa at position 362 is Leu, Ala, Val, Gly, or Ile
  SITE (374)..(374): Xaa at position 374 is Phe, Tyr, Met, His, Ile, Leu, Val Ala, or Gly
  SITE (376)..(376): Xaa at position 376 is Met, Ile, Leu, Val, Ala, or Gly
  SITE (377)..(377): Xaa at position 377 is Leu, Ala, Val, Gly, or Ile
  SITE (379)..(379): Xaa at position 379 is Ile, Ala, Val, Leu, or Gly
  SITE (382)..(382): Xaa at position 382 is Ala, Gly, or Pro
  SITE (396)..(396): Xaa at position 396 is Ile, Ala, Val, Leu, or Gly
  SITE (397)..(397): Xaa at position 397 is Val, Ala, Gly, Leu, or Ile
  SITE (409)..(409): Xaa at position 409 is Phe, Tyr, Met, His, Ile, Leu, Val Ala, or Gly
  SITE (410)..(410): Xaa at position 410 is Ile, Ala, Val, Leu, or Gly
  SITE (420)..(420): Xaa at position 420 is Tyr, Phe, Met, His, Ile, Leu, Val Ala, or Gly
  SITE (424)..(424): Xaa at position 424 is Phe, Tyr, Met, His, Ile, Leu, Val Ala, or Gly
  SITE (425)..(425): Xaa at position 425 is Tyr, Phe, Met, His, Ile, Leu, Val Ala, or Gly
  SITE (426)..(426): Xaa at position 426 is Val, Ala, Gly, Leu, or Ile
  SITE (428)..(428): Xaa at position 428 is Leu, Ala, Val, Gly, or Ile
  SITE (439)..(439): Xaa at position 439 is Val, Ala, Gly, Leu, or Ile
  SITE (446)..(446): Xaa at position 446 is Leu, Ala, Val, Gly, or Ile
  SITE (447)..(447): Xaa at position 447 is Ile, Ala, Val, Leu, or Gly
  SITE (448)..(448): Xaa at position 448 is Ala, Gly, or Pro
  SITE (449)..(449): Xaa at position 449 is Leu, Ala, Val, Gly, or Ile
  SITE (465)..(465): Xaa at position 465 is Ala, Gly, or Pro
  SITE (467)..(467): Xaa at position 467 is Ile, Ala, Val, Leu, or Gly
MNPNQKLFALSGVAIALSVLNLLIGISNVGLNVSLHLKGAGTKQEENLTCTTITQNNTTVVENTYVNNTTIITKEPEFRAPSYLLXNKSLCNXEGWVVVAKDNXXRFGESEQXIXTREPXXSXDPSGCKXXXXHQGTTIRNKHSNGTIHDRTAFRGXXSTHLGTPPTVSNSDFIXXGWSSTSXHDGIGRXTXXXQGNNDNXTXTXYXNRRLTTTIKTWXRNIXRTQESEXXXHNGTCXXXXTDGSASSQAYTKXXXXHKGLVIKEEPLKGSAKHXEEXSXXGHNQKXTXXXRDNWQGXNRPXXEXDMTTLEHTSRXXXTGXXTDTSRPGDKPSGDCSNPITGSPGAPGXKGXGXLNGDNTXXGRTISPRSRSGXEXXKXPNXGTDPNSKIVERQEXXDNNNWSGYSGSXXDYWDDGNECXNPCXXXEXIRGRPEEAKYXWWTSNSXXXXCGSPFPVGSGSFPDGXQXQYFS

SEQ ID NO: 657 - protein, 561 aa, Influenza A virus
  strain A/Duck/Germany/1949 H10N7
  SITE (26)..(26): Xaa at position 26 is Ala, Gly, or Pro
  SITE (50)..(50): Xaa at position 50 is Val, Ala, Gly, Leu, or Ile
  SITE (58)..(58): Xaa at position 58 is Leu, Ala, Val, Gly, or Ile
  SITE (59)..(59): Xaa at position 59 is Cys, Ala, Val, Gly, Ser, or Thr
  SITE (60)..(60): Xaa at position 60 is Met, Ile, Leu, Val, Ala, or Gly
  SITE (65)..(65): Xaa at position 65 is Tyr, Phe, Met, His, Ile, Leu, Val Ala, or Gly
  SITE (68)..(68): Xaa at position 68 is Leu, Ala, Val, Gly, or Ile
  SITE (71)..(71): Xaa at position 71 is Cys, Ala, Val, Gly, Ser, or Thr
  SITE (74)..(74): Xaa at position 74 is Val, Ala, Gly, Leu, or Ile
  SITE (76)..(76): Xaa at position 76 is Met, Ile, Leu, Val, Ala, or Gly
  SITE (78)..(78): Xaa at position 78 is Ile, Ala, Val, Leu, or Gly
  SITE (83)..(83): Xaa at position 83 is Cys, Ala, Val, Gly, Ser, or Thr
  SITE (91)..(91): Xaa at position 91 is Trp, Tyr, Phe, Met, His, Ile, Leu Val, Ala, or Gly
  SITE (94)..(94): Xaa at position 94 is Leu, Ala, Val, Gly, or Ile
  SITE (95)..(95): Xaa at position 95 is Ile, Ala, Val, Leu, or Gly
  SITE (101)..(101): Xaa at position 101 is Ile, Ala, Val, Leu, or Gly
  SITE (104)..(104): Xaa at position 104 is Cys, Ala, Val, Gly, Ser, or Thr
  SITE (115)..(115): Xaa at position 115 is Leu, Ala, Val, Gly, or Ile
  SITE (119)..(119): Xaa at position 119 is Ile, Ala, Val, Leu, or Gly
  SITE (125)..(125): Xaa at position 125 is Ile, Ala, Val, Leu, or Gly
  SITE (128)..(128): Xaa at position 128 is Met, Ile, Leu, Val, Ala, or Gly
  SITE (138)..(138): Xaa at position 138 is Ile, Ala, Val, Leu, or Gly
  SITE (147)..(147): Xaa at position 147 is Cys, Ala, Val, Gly, Ser, or Thr
  SITE (156)..(156): Xaa at position 156 is Tyr, Phe, Met, His, Ile, Leu, Val Ala, or Gly
  SITE (159)..(159): Xaa at position 159 is Leu, Ala, Val, Gly, or Ile
  SITE (162)..(162): Xaa at position 162 is Leu, Ala, Val, Gly, or Ile
  SITE (178)..(178): Xaa at position 178 is Tyr, Phe, Met, His, Ile, Leu, Val Ala, or Gly
  SITE (186)..(186): Xaa at position 186 is His, Phe, Tyr, Lys, Arg, Gly, Ser Thr, Ala, Val, Leu, Ile, Asn, Met, or Gln
  SITE (187)..(187): Xaa at position 187 is Leu, Ala, Val, Gly, or Ile
  SITE (188)..(188): Xaa at position 188 is Ile, Ala, Val, Leu, or Gly
  SITE (189)..(189): Xaa at position 189 is Ile, Ala, Val, Leu, or Gly
  SITE (190)..(190): Xaa at position 190 is Trp, Tyr, Phe, Met, His, Ile, Leu Val, Ala, or Gly
  SITE (192)..(192): Xaa at position 192 is Ile, Ala, Val, Leu, or Gly
  SITE (193)..(193): Xaa at position 193 is His, Phe, Tyr, Lys, Arg, Gly, Ser Thr, Ala, Val, Leu, Ile, Asn, Met, or Gln
  SITE (205)..(205): Xaa at position 205 is Tyr, Phe, Met, His, Ile, Leu, Val Ala, or Gly
  SITE (212)..(212): Xaa at position 212 is Ile, Ala, Val, Leu, or Gly
  SITE (214)..(214): Xaa at position 214 is Val, Ala, Gly, Leu, or Ile
  SITE (240)..(240): Xaa at position 240 is Ile, Ala, Val, Leu, or Gly
  SITE (242)..(242): Xaa at position 242 is Phe, Tyr, Met, His, Ile, Leu, Val Ala, or Gly
  SITE (247)..(247): Xaa at position 247 is Val, Ala, Gly, Leu, or Ile
  SITE (253)..(253): Xaa at position 253 is Ile, Ala, Val, Leu, or Gly
  SITE (255)..(255): Xaa at position 255 is Phe, Tyr, Met, His, Ile, Leu, Val Ala, or Gly
  SITE (257)..(257): Xaa at position 257 is His, Phe, Tyr, Lys, Arg, Gly, Ser Thr, Ala, Val, Leu, Ile, Asn, Met, or Gln
  SITE (261)..(261): Xaa at position 261 is Leu, Ala, Val, Gly, or Ile
  SITE (262)..(262): Xaa at position 262 is Ile, Ala, Val, Leu, or Gly
  SITE (263)..(263): Xaa at position 263 is Ala, Gly, or Pro
  SITE (267)..(267): Xaa at position 267 is Val, Ala, Gly, Leu, or Ile
  SITE (270)..(270): Xaa at position 270 is Leu, Ala, Val, Gly, or Ile
  SITE (277)..(277): Xaa at position 277 is Ile, Ala, Val, Leu, or Gly
  SITE (287)..(287): Xaa at position 287 is Cys, Ala, Val, Gly, Ser, or Thr
  SITE (291)..(291): Xaa at position 291 is Cys, Ala, Val, Gly, Ser, or Thr
  SITE (292)..(292): Xaa at position 292 is Phe, Tyr, Met, His, Ile, Leu, Val Ala, or Gly
  SITE (345)..(345): Xaa at position 345 is Ala, Gly, or Pro
  SITE (362)..(362): Xaa at position 362 is Tyr, Phe, Met, His, Ile, Leu, Val Ala, or Gly
  SITE (384)..(384): Xaa at position 384 is Ala, Gly, or Pro
  SITE (458)..(458): Xaa at position 458 is Leu, Ala, Val, Gly, or Ile
  SITE (466)..(466): Xaa at position 466 is Leu, Ala, Val, Gly, or Ile
  SITE (482)..(482): Xaa at position 482 is His, Phe, Tyr, Lys, Arg, Gly, Ser Thr, Ala, Val, Leu, Ile, Asn, Met, or Gln
  SITE (484)..(484): Xaa at position 484 is Cys, Ala, Val, Gly, Ser, or Thr
  SITE (488)..(488): Xaa at position 488 is Cys, Ala, Val, Gly, Ser, or Thr
  SITE (506)..(506): Xaa at position 506 is Ala, Gly, or Pro
MYKVVVIIALLGAVKGLDRICLGHHXVANGTIVKTLTNEQEEVTNATETXESTNLNKXXXKGRSXKDXGNXHPXGXLXGTPVXDPHLTGTXDTXXERENAXAHXYPGATINEEAXRQKXMESGGXSKXSTGFTYGSSXNSAGTTKAXMRNGGDSFXAEXKWXVSKTKGQNFPQTTNTXRNTDTAEXXXXXGXXHPSSTQEKNDLXGTQSLSXSXESSTYQNNFVPVVGARPQVNGQSGRXDXHWTLXQPGDNXTXSXNGGXXXPSRXSKXTGRGLGXQSEALIDNSXESKXXWRGGSINTKLPFQNLSPRTVGQCPKYVNQRSLLLATGMRNVPEVVQGRGLFGXIAGFIENGWEGMVDGWXGFRHQNAQGTGQAADYKSTQAXIDQITGKLNRLIEKTNTEFESIESEFSETEHQIGNVINWTKDSITDIWTYQAELLVAMENQHTIDMADSEMLNXYERVRKQXRQNAEEDGKGCFEIYXTXDDSXMESIRNNTYDHSQYREEXLLNRLNINSVKLSSGYKDIILWFSFGASCFVLLAVVMGLVFFCLKNGNMRCTICI

SEQ ID NO: 658 - protein, 857 aa, Human immunodeficiency virus 1
  SITE (54)..(54): Xaa at position 54 is Ala, Gly, or Pro
  SITE (65)..(65): Xaa at position 65 is His, Phe, Tyr, Lys, Arg, Gly, Ser Thr, Ala, Val, Leu, Ile, Asn, Met, or Gln
  SITE (69)..(69): Xaa at position 69 is Ala, Gly, or Pro
  SITE (94)..(94): Xaa at position 94 is Met, Ile, Leu, Val, Ala, or Gly
  SITE (99)..(99): Xaa at position 99 is Met, Ile, Leu, Val, Ala, or Gly
  SITE (100)..(100): Xaa at position 100 is Val, Ala, Gly, Leu, or Ile
  SITE (103)..(103): Xaa at position 103 is Met, Ile, Leu, Val, Ala, or Gly
  SITE (110)..(110): Xaa at position 110 is Leu, Ala, Val, Gly, or Ile
  SITE (111)..(111): Xaa at position 111 is Trp, Tyr, Phe, Met, His, Ile, Leu Val, Ala, or Gly
  SITE (115)..(115): Xaa at position 115 is Leu, Ala, Val, Gly, or Ile
  SITE (119)..(119): Xaa at position 119 is Val, Ala, Gly, Leu, or Ile
  SITE (154)..(154): Xaa at position 154 is Val, Ala, Gly, Leu, or Ile
  SITE (165)..(165): Xaa at position 165 is Ile, Ala, Val, Leu, or Gly
  SITE (193)..(193): Xaa at position 193 is Tyr, Phe, Met, His, Ile, Leu, Val Ala, or Gly
  SITE (220)..(220): Xaa at position 220 is Cys, Ala, Val, Gly, Ser, or Thr
  SITE (226)..(226): Xaa at position 226 is Val, Ala, Gly, Leu, or Ile
  SITE (227)..(227): Xaa at position 227 is Ile, Ala, Val, Leu, or Gly
  SITE (228)..(228): Xaa at position 228 is Leu, Ala, Val, Gly, or Ile
  SITE (230)..(230): Xaa at position 230 is Cys, Ala, Val, Gly, Ser, or Thr
  SITE (241)..(241): Xaa at position 241 is Cys, Ala, Val, Gly, Ser, or Thr
  SITE (244)..(244): Xaa at position 244 is Val, Ala, Gly, Leu, or Ile
  SITE (253)..(253): Xaa at position 253 is Ile, Ala, Val, Leu, or Gly
  SITE (261)..(261): Xaa at position 261 is Leu, Ala, Val, Gly, or Ile
  SITE (272)..(272): Xaa at position 272 is Ile, Ala, Val, Leu, or Gly
  SITE (286)..(286): Xaa at position 286 is Ile, Ala, Val, Leu, or Gly
  SITE (287)..(287): Xaa at position 287 is Ile, Ala, Val, Leu, or Gly
  SITE (288)..(288): Xaa at position 288 is Val, Ala, Gly, Leu, or Ile
  SITE (289)..(289): Xaa at position 289 is His, Phe, Tyr, Lys, Arg, Gly, Ser Thr, Ala, Val, Leu, Ile, Asn, Met, or Gln
  SITE (290)..(290): Xaa at position 290 is Leu, Ala, Val, Gly, or Ile
  SITE (294)..(294): Xaa at position 294 is Val, Ala, Gly, Leu, or Ile
  SITE (296)..(296): Xaa at position 296 is Ile, Ala, Val, Leu, or Gly
  SITE (298)..(298): Xaa at position 298 is Cys, Ala, Val, Gly, Ser, or Thr
  SITE (327)..(327): Xaa at position 327 is Ile, Ala, Val, Leu, or Gly
  SITE (330)..(330): Xaa at position 330 is Ala, Gly, or Pro
  SITE (332)..(332): Xaa at position 332 is Cys, Ala, Val, Gly, Ser, or Thr
  SITE (334)..(334): Xaa at position 334 is Ile, Ala, Val, Leu, or Gly
  SITE (339)..(339): Xaa at position 339 is Trp, Tyr, Phe, Met, His, Ile, Leu Val, Ala, or Gly
  SITE (343)..(343): Xaa at position 343 is Leu, Ala, Val, Gly, or Ile
  SITE (346)..(346): Xaa at position 346 is Val, Ala, Gly, Leu, or Ile
  SITE (350)..(350): Xaa at position 350 is Leu, Ala, Val, Gly, or Ile
  SITE (359)..(359): Xaa at position 359 is Ile, Ala, Val, Leu, or Gly
  SITE (360)..(360): Xaa at position 360 is Ile, Ala, Val, Leu, or Gly
  SITE (361)..(361): Xaa at position 361 is Phe, Tyr, Met, His, Ile, Leu, Val Ala, or Gly
  SITE (374)..(374): Xaa at position 374 is His, Phe, Tyr, Lys, Arg, Gly, Ser Thr, Ala, Val, Leu, Ile, Asn, Met, or Gln
  SITE (378)..(378): Xaa at position 378 is Cys, Ala, Val, Gly, Ser, or Thr
  SITE (382)..(382): Xaa at position 382 is Phe, Tyr, Met, His, Ile, Leu, Val Ala, or Gly
  SITE (383)..(383): Xaa at position 383 is Phe, Tyr, Met, His, Ile, Leu, Val Ala, or Gly
  SITE (384)..(384): Xaa at position 384 is Tyr, Phe, Met, His, Ile, Leu, Val Ala, or Gly
  SITE (385)..(385): Xaa at position 385 is Cys, Ala, Val, Gly, Ser, or Thr
  SITE (390)..(390): Xaa at position 390 is Leu, Ala, Val, Gly, or Ile
  SITE (391)..(391): Xaa at position 391 is Phe, Tyr, Met, His, Ile, Leu, Val Ala, or Gly
  SITE (410)..(410): Xaa at position 410 is Leu, Ala, Val, Gly, or Ile
  SITE (412)..(412): Xaa at position 412 is Cys, Ala, Val, Gly, Ser, or Thr
  SITE (414)..(414): Xaa at position 414 is Ile, Ala, Val, Leu, or Gly
  SITE (417)..(417): Xaa at position 417 is Ile, Ala, Val, Leu, or Gly
  SITE (418)..(418): Xaa at position 418 is Ile, Ala, Val, Leu, or Gly
  SITE (427)..(427): Xaa at position 427 is Ala, Gly, or Pro
  SITE (428)..(428): Xaa at position 428 is Met, Ile, Leu, Val, Ala, or Gly
  SITE (437)..(437): Xaa at position 437 is Ile, Ala, Val, Leu, or Gly
  SITE (443)..(443): Xaa at position 443 is Ile, Ala, Val, Leu, or Gly
  SITE (446)..(446): Xaa at position 446 is Ile, Ala, Val, Leu, or Gly
  SITE (447)..(447): Xaa at position 447 is Leu, Ala, Val, Gly, or Ile
  SITE (448)..(448): Xaa at position 448 is Leu, Ala, Val, Gly, or Ile
  SITE (462)..(462): Xaa at position 462 is Phe, Tyr, Met, His, Ile, Leu, Val Ala, or Gly
  SITE (473)..(473): Xaa at position 473 is Trp, Tyr, Phe, Met, His, Ile, Leu Val, Ala, or Gly
  SITE (477)..(477): Xaa at position 477 is Leu, Ala, Val, Gly, or Ile
  SITE (480)..(480): Xaa at position 480 is Tyr, Phe, Met, His, Ile, Leu, Val Ala, or Gly
  SITE (483)..(483): Xaa at position 483 is Val, Ala, Gly, Leu, or Ile
  SITE (485)..(485): Xaa at position 485 is Ile, Ala, Val, Leu, or Gly
  SITE (499)..(499): Xaa at position 499 is Val, Ala, Gly, Leu, or Ile
  SITE (542)..(542): Xaa at position 542 is Ile, Ala, Val, Leu, or Gly
  SITE (549)..(549): Xaa at position 549 is Leu, Ala, Val, Gly, or Ile
  SITE (552)..(552): Xaa at position 552 is Ala, Gly, or Pro
  SITE (553)..(553): Xaa at position 553 is Ile, Ala, Val, Leu, or Gly
  SITE (555)..(555): Xaa at position 555 is Ala, Gly, or Pro
  SITE (559)..(559): Xaa at position 559 is Leu, Ala, Val, Gly, or Ile
  SITE (560)..(560): Xaa at position 560 is Leu, Ala, Val, Gly, or Ile
  SITE (564)..(564): Xaa at position 564 is Val, Ala, Gly, Leu, or Ile
  SITE (567)..(567): Xaa at position 567 is Ile, Ala, Val, Leu, or Gly
  SITE (570)..(570): Xaa at position 570 is Leu, Ala, Val, Gly, or Ile
  SITE (574)..(574): Xaa at position 574 is Val, Ala, Gly, Leu, or Ile
MRVKETQMNWPNLWKWGTLILGLVIICSASDNLWVTVYYGVPVWKDADTTLFCXSDAKAHETEVXNVWXTHACVPTDPNPQEIHLENVTENFNXWKNNXXEQXQEDVISXXDQSXQPCXKLTPLCVTLHCTTAKLTNVTNITNVPNIGNITDEXRNCSFNMTTEXRDKKQKVHALFYKLDIVQIEDKNDSSKXRLINCNTSVIKQACPKISFDPIPIHYXTPAGYXXXKXNDKNFNGTGPXKNXSSVQCTHGXKPVVSTQXLLNGSLAEEEXIIRSENLTNNAKTXXXXXNKSXEXNXTRPSNNMRTSMRIGPGQVFYRTGSITGDXRKXYXEXNGTKXNKVXKQXTEKXKEHFNNKTXXXQPPSGGDLEITMXHFNXRGEXXXXNTTQXXNNTCIGNETMKGCNGTITXPXKXKQXXNMWQGTGQXXYAPPIDGKXNCVSNXTGXXXTRDGGANNTSNETXRPGGGNIKDNXRSEXYKXKVXQXEPLGIAPTRAKRRXVEREKRAVGIGAMIFGFLGAAGSTMGAASITLTVQARQLLSGXVQQQSNXLRXXEXQQHXXQLTXWGXKQXQARXLAVERYLKDQKFLGLWGCSGKIICTTAVPWNSTWSNKSFEEIWNNMTWIEWEREISNYTNQIYEILTESQNQQDRNEKDLLELDKWASLWNWFDITNWLWYIKIFIMIVGGLIGLRIIFAVLSIVNRVRQGYSPLSFQTPIHHQREPDRPERIEEGGGEQGRDRSVRLVSGFLSLAWDDLRSLCLFSYHRLRDFILIATRTVELLGHSSLKGLRRGWEGLKYLGNLLLYWGQELKISAISLLNTTAIAVAGWTDRVIEVAQGAWRAILHIPRRIRQGLERTLL

SEQ ID NO: 659 - protein, 349 aa, Homo sapiens; identical to SEQ ID NO: 457
  SITE (36)..(36): Xaa at position 36 is Leu, Ala, Val, Gly, or Ile
  SITE (45)..(45): Xaa at position 45 is Ala, Gly, or Pro
  SITE (51)..(51): Xaa at position 51 is Val, Ala, Gly, Leu, or Ile
  SITE (52)..(52): Xaa at position 52 is Leu, Ala, Val, Gly, or Ile
  SITE (53)..(53): Xaa at position 53 is Leu, Ala, Val, Gly, or Ile
  SITE (55)..(55): Xaa at position 55 is Val, Ala, Gly, Leu, or Ile
  SITE (65)..(65): Xaa at position 65 is Tyr, Phe, Met, His, Ile, Leu, Val Ala, or Gly
  SITE (67)..(67): Xaa at position 67 is Trp, Tyr, Phe, Met, His, Ile, Leu Val, Ala, or Gly
  SITE (79)..(79): Xaa at position 79 is Ile, Ala, Val, Leu, or Gly
  SITE (80)..(80): Xaa at position 80 is Ile, Ala, Val, Leu, or Gly
  SITE (105)..(105): Xaa at position 105 is Ala, Gly, or Pro
  SITE (107)..(107): Xaa at position 107 is Leu, Ala, Val, Gly, or Ile
  SITE (109)..(109): Xaa at position 109 is Met, Ile, Leu, Val, Ala, or Gly
  SITE (112)..(112): Xaa at position 112 is Val, Ala, Gly, Leu, or Ile
  SITE (120)..(120): Xaa at position 120 is Tyr, Phe, Met, His, Ile, Leu, Val Ala, or Gly
  SITE (122)..(122): Xaa at position 122 is Leu, Ala, Val, Gly, or Ile
  SITE (124)..(124): Xaa at position 124 is Val, Ala, Gly, Leu, or Ile
  SITE (138)..(138): Xaa at position 138 is Phe, Tyr, Met, His, Ile, Leu, Val Ala, or Gly

SEQ ID NO: 660 - protein, 1351 aa, Human coronavirus HKU1
  isolate N5 (HCoV-HKU1)
  SITE (67)..(67): Xaa at position 67 is Phe, Tyr, Met, His, Ile, Leu, Val Ala, or Gly
  SITE (103)..(103): Xaa at position 103 is Phe, Tyr, Met, His, Ile, Leu, Val Ala, or Gly
  SITE (106)..(106): Xaa at position 106 is Val, Ala, Gly, Leu, or Ile
  SITE (125)..(125): Xaa at position 125 is Val, Ala, Gly, Leu, or Ile
  SITE (137)..(137): Xaa at position 137 is Ile, Ala, Val, Leu, or Gly
  SITE (138)..(138): Xaa at position 138 is Val, Ala, Gly, Leu, or Ile
  SITE (150)..(150): Xaa at position 150 is Ala, Gly, or Pro
  SITE (151)..(151): Xaa at position 151 is Cys, Ala, Val, Gly, Ser, or Thr
  SITE (156)..(156): Xaa at position 156 is Cys, Ala, Val, Gly, Ser, or Thr
  SITE (162)..(162): Xaa at position 162 is Val, Ala, Gly, Leu, or Ile
  SITE (198)..(198): Xaa at position 198 is Leu, Ala, Val, Gly, or Ile
  SITE (201)..(201): Xaa at position 201 is His, Phe, Tyr, Lys, Arg, Gly, Ser Thr, Ala, Val, Leu, Ile, Asn, Met, or Gln
  SITE (209)..(209): Xaa at position 209 is Phe, Tyr, Met, His, Ile, Leu, Val Ala, or Gly
  SITE (211)..(211): Xaa at position 211 is Ala, Gly, or Pro
  SITE (212)..(212): Xaa at position 212 is Tyr, Phe, Met, His, Ile, Leu, Val Ala, or Gly
  SITE (214)..(214): Xaa at position 214 is Ala, Gly, or Pro
  SITE (222)..(222): Xaa at position 222 is Phe, Tyr, Met, His, Ile, Leu, Val Ala, or Gly
  SITE (236)..(236): Xaa at position 236 is Tyr, Phe, Met, His, Ile, Leu, Val Ala, or Gly
  SITE (237)..(237): Xaa at position 237 is Val, Ala, Gly, Leu, or Ile
  SITE (238)..(238): Xaa at position 238 is Met, Ile, Leu, Val, Ala, or Gly
  SITE (242)..(242): Xaa at position 242 is Cys, Ala, Val, Gly, Ser, or Thr
  SITE (256)..(256): Xaa at position 256 is Tyr, Phe, Met, His, Ile, Leu, Val Ala, or Gly
  SITE (266)..(266): Xaa at position 266 is Tyr, Phe, Met, His, Ile, Leu, Val Ala, or Gly
  SITE (267)..(267): Xaa at position 267 is Leu, Ala, Val, Gly, or Ile
  SITE (268)..(268): Xaa at position 268 is Leu, Ala, Val, Gly, or Ile
  SITE (279)..(279): Xaa at position 279 is Ala, Gly, or Pro
  SITE (282)..(282): Xaa at position 282 is Cys, Ala, Val, Gly, Ser, or Thr
  SITE (333)..(333): Xaa at position 333 is Leu, Ala, Val, Gly, or Ile
  SITE (352)..(352): Xaa at position 352 is Cys, Ala, Val, Gly, Ser, or Thr
  SITE (383)..(383): Xaa at position 383 is Phe, Tyr, Met, His, Ile, Leu, Val Ala, or Gly
  SITE (388)..(388): Xaa at position 388 is Val, Ala, Gly, Leu, or Ile
  SITE (391)..(391): Xaa at position 391 is Phe, Tyr, Met, His, Ile, Leu, Val Ala, or Gly
  SITE (392)..(392): Xaa at position 392 is Ala, Gly, or Pro
  SITE (409)..(409): Xaa at position 409 is Leu, Ala, Val, Gly, or Ile
  SITE (423)..(423): Xaa at position 423 is Cys, Ala, Val, Gly, Ser, or Thr
  SITE (427)..(427): Xaa at position 427 is Tyr, Phe, Met, His, Ile, Leu, Val Ala, or Gly
  SITE (458)..(458): Xaa at position 458 is Tyr, Phe, Met, His, Ile, Leu, Val Ala, or Gly
  SITE (477)..(477): Xaa at position 477 is Ala, Gly, or Pro
  SITE (588)..(588): Xaa at position 588 is Ile, Ala, Val, Leu, or Gly
  SITE (589)..(589): Xaa at position 589 is Phe, Tyr, Met, His, Ile, Leu, Val Ala, or Gly
  SITE (624)..(624): Xaa at position 624 is Leu, Ala, Val, Gly, or Ile
  SITE (633)..(633): Xaa at position 633 is Phe, Tyr, Met, His, Ile, Leu, Val Ala, or Gly
  SITE (680)..(680): Xaa at position 680 is Ala, Gly, or Pro
  SITE (719)..(719): Xaa at position 719 is Cys, Ala, Val, Gly, Ser, or Thr
  SITE (743)..(743): Xaa at position 743 is Cys, Ala, Val, Gly, Ser, or Thr
  SITE (765)..(765): Xaa at position 765 is Val, Ala, Gly, Leu, or Ile
  SITE (943)..(943): Xaa at position 943 is Ile, Ala, Val, Leu, or Gly
  SITE (1025)..(1025): Xaa at position 1025 is Ala, Gly, or Pro
  SITE (1070)..(1070): Xaa at position 1070 is Ala, Gly, or Pro
  SITE (1084)..(1084): Xaa at position 1084 is Ala, Gly, or Pro
  SITE (1085)..(1085): Xaa at position 1085 is Leu, Ala, Val, Gly, or Ile
  SITE (1098)..(1098): Xaa at position 1098 is Leu, Ala, Val, Gly, or Ile
  SITE (1103)..(1103): Xaa at position 1103 is Ala, Gly, or Pro
  SITE (1106)..(1106): Xaa at position 1106 is Ala, Gly, or Pro
  SITE (1143)..(1143): Xaa at position 1143 is Phe, Tyr, Met, His, Ile, Leu Val, Ala, or Gly
  SITE (1144)..(1144): Xaa at position 1144 is Ile, Ala, Val, Leu, or Gly
MFLIIFILPTTLAVIGDFNCTNSFINDYNKTIPRISEDVVDVSLGLGTYYVLNRVYLNTTLLFTGYXPKSGANFRDLALKGSIYLSTLWYKPPFLSDFNNGIXSKXKNTKLYVNNTLYSEFSTIXIGSVFVNTSYTXXVQPHNGILEITXXQYTMXEYPHTXCKSKGSIRNESWHIDSSEPLCLFKKNFTYNVSADWXYFXFYQERGVXYXXYXDVGMPTTXLFSLYLGTILSHYXXXPLTXNAISSNTDNETLEXWVTPLSRRQXXXNFDEHGVITNXVDXSSSFLSEIQCKTQSFAPNTGVYDLSGFTVKPVATVYRRIPNLPDCDIDNWXNNVSVPSPLNWERRIFSNXNFNLSTLLRLVHVDSFSCNNLDKSKIFGSCXNSITXDKXXIPNRRRDDLQLGSSGFXQSSNYKIDISSSSXQLYXSLPLVNVTINNFNPSSWNRRYGFGSFNLSSXDVVYSDHCFSVNSDFCPCXDPSVVNSCAKSKPPSAICPAGTKYRHCDLDTTLYVKNWCRCSCLPDPISTYSPNTCPQKKVVVGIGEHCPGLGINEEKCGTQLNHSSCFCSPDAFLGWSFDSCISNNRCNXXSNFIFNGINSGTTCSNDLLYSNTEISTGVCVNYDXYGITGQGIXKEVSAAYYNNWQNLLYDSNGNIIGFKDFLTNKTYTILPCYSGRVSAXFYQNSSSPALLYRNLKCSYVLNNISFISQPFYFDSYLGXVLNAVNLTSYSVSSCDLRMGSGFXIDYALPSSRRKRRGISSPYRFXTFEPFNVSFVNDSVETVGGLFEIQIPTNFTIAGHEEFIQTSSPKVTIDCSAFVCSNYAACHDLLSEYGTFCDNINSILNEVNDLLDITQLQVANALMQGVTLSSNLNTNLHSDVDNIDFKSLLGCLGSQCGSSSRSLLEDLLFNKVKLSDVGFVEAYNNCTGGSEIRDLLCVQSFNGXKVLPPILSETQISGYTTAATVAAMFPPWSAAAGVPFSLNVQYRINGLGVTMDVLNKNQKLIANAFNKALLSIQNGFTATNSXLAKIQSVVNANAQALNSLLQQLFNKFGAISSSLQEILSRLDNLEXQVQIDRLINGRLTXXNAYVSQQLSDITXIKAGXSRXIEKVNECVKSQSPRINFCGNGNHILSLVQNAPYGLLXXHFSYKPTSFKTVLVSPGLCLSGDRGIAPKQGYFIKQNDSWMFTGSSYYYPEPISDKNVVFMNSCSVNFTKAPFIYLNNSIPNLSDFEAELSLWFKNHTSIAPNLTFNSHINATFLDLYYEMNVIQESIKSLNSSFINLKEIGTYEMYVKWPWYIWLLIVILFIIFLMILFFICCCTGCGSACFSKCHNCCDEYGGHNDFVIKASHDD

SEQ ID NO: 661 - protein, 181 aa, Hepatitis C virus
  SITE (16)..(16): Xaa at position 16 is Cys, Ala, Val, Gly, Ser, or Thr
  SITE (33)..(33): Xaa at position 33 is Val, Ala, Gly, Leu, or Ile
  SITE (35)..(35): Xaa at position 35 is Val, Ala, Gly, Leu, or Ile
  SITE (36)..(36): Xaa at position 36 is Val, Ala, Gly, Leu, or Ile
  SITE (44)..(44): Xaa at position 44 is Leu, Ala, Val, Gly, or Ile
  SITE (45)..(45): Xaa at position 45 is Ala, Gly, or Pro
  SITE (47)..(47): Xaa at position 47 is Cys, Ala, Val, Gly, Ser, or Thr
  SITE (48)..(48): Xaa at position 48 is Val, Ala, Gly, Leu, or Ile
  SITE (51)..(51): Xaa at position 51 is Val, Ala, Gly, Leu, or Ile
  SITE (52)..(52): Xaa at position 52 is Cys, Ala, Val, Gly, Ser, or Thr
  SITE (53)..(53): Xaa at position 53 is Trp, Tyr, Phe, Met, His, Ile, Leu Val, Ala, or Gly
  SITE (55)..(55): Xaa at position 55 is Val, Ala, Gly, Leu, or Ile
  SITE (59)..(59): Xaa at position 59 is Ala, Gly, or Pro
  SITE (64)..(64): Xaa at position 64 is Leu, Ala, Val, Gly, or Ile
  SITE (71)..(71): Xaa at position 71 is Ile, Ala, Val, Leu, or Gly
  SITE (82)..(82): Xaa at position 82 is Leu, Ala, Val, Gly, or Ile
  SITE (83)..(83): Xaa at position 83 is Val, Ala, Gly, Leu, or Ile
  SITE (85)..(85): Xaa at position 85 is Trp, Tyr, Phe, Met, His, Ile, Leu Val, Ala, or Gly
  SITE (94)..(94): Xaa at position 94 is Leu, Ala, Val, Gly, or Ile
  SITE (104)..(104): Xaa at position 104 is Leu, Ala, Val, Gly, or Ile
  SITE (106)..(106): Xaa at position 106 is Leu, Ala, Val, Gly, or Ile
  SITE (107)..(107): Xaa at position 107 is Val, Ala, Gly, Leu, or Ile
  SITE (113)..(113): Xaa at position 113 is Val, Ala, Gly, Leu, or Ile
  SITE (114)..(114): Xaa at position 114 is Ile, Ala, Val, Leu, or Gly
  SITE (116)..(116): Xaa at position 116 is Val, Ala, Gly, Leu, or Ile
  SITE (132)..(132): Xaa at position 132 is Val, Ala, Gly, Leu, or Ile
  SITE (135)..(135): Xaa at position 135 is Leu, Ala, Val, Gly, or Ile
  SITE (143)..(143): Xaa at position 143 is Leu, Ala, Val, Gly, or Ile
  SITE (144)..(144): Xaa at position 144 is Leu, Ala, Val, Gly, or Ile
  SITE (145)..(145): Xaa at position 145 is Cys, Ala, Val, Gly, Ser, or Thr
  SITE (150)..(150): Xaa at position 150 is Ala, Gly, or Pro
  SITE (151)..(151): Xaa at position 151 is Val, Ala, Gly, Leu, or Ile
  SITE (153)..(153): Xaa at position 153 is Ile, Ala, Val, Leu, or Gly
  SITE (154)..(154): Xaa at position 154 is Phe, Tyr, Met, His, Ile, Leu, Val Ala, or Gly
  SITE (164)..(164): Xaa at position 164 is Ala, Gly, or Pro
  SITE (166)..(166): Xaa at position 166 is Ala, Gly, or Pro
  SITE (167)..(167): Xaa at position 167 is Val, Ala, Gly, Leu, or Ile
  SITE (169)..(169): Xaa at position 169 is Phe, Tyr, Met, His, Ile, Leu, Val Ala, or Gly
  SITE (170)..(170): Xaa at position 170 is Val, Ala, Gly, Leu, or Ile
  SITE (172)..(172): Xaa at position 172 is Val, Ala, Gly, Leu, or Ile
  SITE (175)..(175): Xaa at position 175 is Met, Ile, Leu, Val, Ala, or Gly
APITAYSQQTRGLLGXIITSLTGRDKNQVEGEXQXXSTATQSFXXTXXNGXXXTXYHGXGSKTXAGPKGPXTQMYTNVDQDXXGXQAPPGARSXTPCTCGSSDXYXXTRHADXXPXRRRGDSRGSLLSPRPXSYXKGSSGGPXXXPSGHXXGXXRAAVCTRGVXKXXDXXPXESXETTMRS

SEQ ID NO: 662 - protein, 1236 aa, Homo sapiens
  SITE (815)..(815): Xaa at position 815 is Phe, Tyr, Met, His, Ile, Leu, Val Ala, or Gly
  SITE (907)..(907): Xaa at position 907 is Leu, Ala, Val, Gly, or Ile
  SITE (922)..(922): Xaa at position 922 is Met, Ile, Leu, Val, Ala, or Gly
  SITE (923)..(923): Xaa at position 923 is Cys, Ala, Val, Gly, Ser, or Thr
  SITE (943)..(943): Xaa at position 943 is Cys, Ala, Val, Gly, Ser, or Thr
  SITE (946)..(946): Xaa at position 946 is Ala, Gly, or Pro
  SITE (955)..(955): Xaa at position 955 is Phe, Tyr, Met, His, Ile, Leu, Val Ala, or Gly
  SITE (1026)..(1026): Xaa at position 1026 is Leu, Ala, Val, Gly, or Ile
  SITE (1037)..(1037): Xaa at position 1037 is Ala, Gly, or Pro
  SITE (1060)..(1060): Xaa at position 1060 is Ile, Ala, Val, Leu, or Gly
  SITE (1104)..(1104): Xaa at position 1104 is Ala, Gly, or Pro
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRPKMSIYKRMRRACCFDCGRSERDCSCMSGRVRGNVDTLERAFPLSSVSVNDCSTSFRAFEDEQPSTLSPKKKQRNGGMRNSPNTSPKLMRHDPLLIPGNDQIDNMDSNVKKYDSTGMXHWCAPKEIEKVILTRSEAAMTVLSGHVVVCIFGDVSSALIGLRNLVMPLRASNFHYHELKHIVFVGSIEYLKREWETLHNFPKVSILPGTPXSRADLRAVNINLCDXXVILSANQNNIDDTSLQDKEXILXSLNIKSMQXDDSIGVLQANSQGFTPPGMDRSSPDNSPVHGMLRQPSITTGVNIPIITELVNDTNVQFLDQDDDDDPDTEXYLTQPFACGTXFAVSVLDSLMSATYFNDNILTLXRTLVTGGATPELEALIAEENALRGGYSTPQTLANRDRCRVAQLXLLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKYVQEERL

SEQ ID NO: 663 - protein, 1159 aa, Homo sapiens
  SITE (30)..(30): Xaa at position 30 is Ile, Ala, Val, Leu, or Gly
  SITE (32)..(32): Xaa at position 32 is Ala, Gly, or Pro
  SITE (44)..(44): Xaa at position 44 is Cys, Ala, Val, Gly, Ser, or Thr
  SITE (48)..(48): Xaa at position 48 is Phe, Tyr, Met, His, Ile, Leu, Val Ala, or Gly
  SITE (49)..(49): Xaa at position 49 is Cys, Ala, Val, Gly, Ser, or Thr
  SITE (51)..(51): Xaa at position 51 is Leu, Ala, Val, Gly, or Ile
  SITE (52)..(52): Xaa at position 52 is Cys, Ala, Val, Gly, Ser, or Thr
  SITE (57)..(57): Xaa at position 57 is Ala, Gly, or Pro
  SITE (59)..(59): Xaa at position 59 is Val, Ala, Gly, Leu, or Ile
  SITE (64)..(64): Xaa at position 64 is Cys, Ala, Val, Gly, Ser, or Thr
  SITE (66)..(66): Xaa at position 66 is Cys, Ala, Val, Gly, Ser, or Thr
  SITE (78)..(78): Xaa at position 78 is Ala, Gly, or Pro
  SITE (82)..(82): Xaa at position 82 is Ile, Ala, Val, Leu, or Gly
  SITE (83)..(83): Xaa at position 83 is Ala, Gly, or Pro
  SITE (96)..(96): Xaa at position 96 is Ile, Ala, Val, Leu, or Gly
  SITE (97)..(97): Xaa at position 97 is Ala, Gly, or Pro
  SITE (98)..(98): Xaa at position 98 is Phe, Tyr, Met, His, Ile, Leu, Val Ala, or Gly
  SITE (105)..(105): Xaa at position 105 is Cys, Ala, Val, Gly, Ser, or Thr
  SITE (110)..(110): Xaa at position 110 is Val, Ala, Gly, Leu, or Ile
  SITE (112)..(112): Xaa at position 112 is Val, Ala, Gly, Leu, or Ile
  SITE (127)..(127): Xaa at position 127 is Leu, Ala, Val, Gly, or Ile
  SITE (763)..(763): Xaa at position 763 is Ala, Gly, or Pro
  SITE (778)..(778): Xaa at position 778 is Ala, Gly, or Pro
  SITE (782)..(782): Xaa at position 782 is Ile, Ala, Val, Leu, or Gly
  SITE (787)..(787): Xaa at position 787 is Ile, Ala, Val, Leu, or Gly
  SITE (804)..(804): Xaa at position 804 is Ile, Ala, Val, Leu, or Gly
  SITE (805)..(805): Xaa at position 805 is Phe, Tyr, Met, His, Ile, Leu, Val Ala, or Gly
  SITE (822)..(822): Xaa at position 822 is Val, Ala, Gly, Leu, or Ile
  SITE (824)..(824): Xaa at position 824 is Ala, Gly, or Pro
  SITE (830)..(830): Xaa at position 830 is Leu, Ala, Val, Gly, or Ile
  SITE (841)..(841): Xaa at position 841 is Val, Ala, Gly, Leu, or Ile
MPVRRGHVAPQNTFLDTIIRKFEGQSRKFXIXNARVENCAVIYXNDGXXEXXGYSRXEXMQRPXTXDFLHGPRTQRRXAAQXXQALLGAEERKVEXXXYRKDGSXFLCLXDXVPVKNEDGAVIMFIXNFEVVMEKDMVGSPAHDTNHRGPPTSWLAPGRAKTFRLKLPALLALTARESSVRSGGAGGAGAPGAVVVDVDLTPAAPSSESLALDEVTAMDNHVAGLGPAEERRALVGPGSPPRSAPGQLPSPRAHSLNPDASGSSCSLARTRSRESCASVRRASSADDIEAMRAGVLPPPPRHASTGAMHPLRSGLLNSTSDSDLVRYRTISKIPQITLNFVDLKGDPFLASPTSDREIIAPKIKERTHNVTEKVTQVLSLGADVLPEYKLQAPRIHRWTILHYSPFKAVWDWLILLLVIYTAVFTPYSAAFLLKETEEGPPATECGYACQPLAVVDLIVDIMFIVDILINFRTTYVNANEEVVSHPGRIAVHYFKGWFLIDMVAAIPFDLLIFGSGSEELIGLLKTARLLRLVRVARKLDRYSEYGAAVLFLLMCTFALIAHWLACIWYAIGNMEQPHMDSRIGWLHNLGDQIGKPYNSSGLGGPSIKDKYVTALYFTFSSLTSVGFGNVSPNTNSEKIFSICVMLIGSLMYASIFGNVSAIIQRLYSGTARYHTQMLRVREFIRFHQIPNPLRQRLEEYFQHAWSYTNGIDMNAVLKGFPECLQADICLHLNRSLLQHCKPFRGATKGCLRALAMKFKTTHXPPGDTLVHAGDLLTXLYFXSRGSXEILRGDVVVAILGKNDXXGEPLNLYARPGKSNGDXRXLTYCDXHKIHRDDLLEXLDMYPEFSDHFWSSLEITFNLRDTNMIPGSPGSTELEGGFSRQRKRKLSFRRRTDKDTEQPGEVSALGPGRAGAGPSSRGRPGGPWGESPSSGPSSPESSEDEGPGRSSSPLRLVPFSSPRPPGEPPGGEPLMEDCEKSSDTCNPLSGAFSGVSNIFSFWGDSRGRQYQELPRCPAPTPSLLNIPLSSPGRRPRGDVESRLDALQRQLNRLETRLSADMATVLQLLQRQMTLVPPAYSAVTTPGPGPTSTSPLLPVSPLPTLTLDSLSQVSQFMACEELPPGAPELPQEGPTRRLSLPGQLGALTSQPLHRHGSDPGS

SEQ ID NO: 664 - protein, 1464 aa, Homo sapiens
  SITE (112)..(112): Xaa at position 112 is Met, Ile, Leu, Val, Ala, or Gly
  SITE (116)..(116): Xaa at position 116 is Ile, Ala, Val, Leu, or Gly
  SITE (136)..(136): Xaa at position 136 is Ala, Gly, or Pro
  SITE (162)..(162): Xaa at position 162 is Met, Ile, Leu, Val, Ala, or Gly
  SITE (170)..(170): Xaa at position 170 is Phe, Tyr, Met, His, Ile, Leu, Val Ala, or Gly
  SITE (177)..(177): Xaa at position 177 is Phe, Tyr, Met, His, Ile, Leu, Val Ala, or Gly
  SITE (187)..(187): Xaa at position 187 is Val, Ala, Gly, Leu, or Ile
  SITE (191)..(191): Xaa at position 191 is Val, Ala, Gly, Leu, or Ile
  SITE (203)..(203): Xaa at position 203 is Val, Ala, Gly, Leu, or Ile
  SITE (217)..(217): Xaa at position 217 is Val, Ala, Gly, Leu, or Ile
  SITE (248)..(248): Xaa at position 248 is Leu, Ala, Val, Gly, or Ile
  SITE (260)..(260): Xaa at position 260 is Leu, Ala, Val, Gly, or Ile
  SITE (292)..(292): Xaa at position 292 is Val, Ala, Gly, Leu, or Ile
  SITE (307)..(307): Xaa at position 307 is Leu, Ala, Val, Gly, or Ile
  SITE (408)..(408): Xaa at position 408 is Ile, Ala, Val, Leu, or Gly
  SITE (409)..(409): Xaa at position 409 is Val, Ala, Gly, Leu, or Ile
  SITE (416)..(416): Xaa at position 416 is Phe, Tyr, Met, His, Ile, Leu, Val Ala, or Gly
  SITE (417)..(417): Xaa at position 417 is Val, Ala, Gly, Leu, or Ile
  SITE (419)..(419): Xaa at position 419 is Val, Ala, Gly, Leu, or Ile
  SITE (436)..(436): Xaa at position 436 is Cys, Ala, Val, Gly, Ser, or Thr
  SITE (440)..(440): Xaa at position 440 is Val, Ala, Gly, Leu, or Ile
  SITE (455)..(455): Xaa at position 455 is Cys, Ala, Val, Gly, Ser, or Thr
  SITE (456)..(456): Xaa at position 456 is Cys, Ala, Val, Gly, Ser, or Thr
  SITE (459)..(459): Xaa at position 459 is Phe, Tyr, Met, His, Ile, Leu, Val Ala, or Gly
  SITE (460)..(460): Xaa at position 460 is Cys, Ala, Val, Gly, Ser, or Thr
  SITE (461)..(461): Xaa at position 461 is Ile, Ala, Val, Leu, or Gly
  SITE (463)..(463): Xaa at position 463 is Ile, Ala, Val, Leu, or Gly
  SITE (464)..(464): Xaa at position 464 is Leu, Ala, Val, Gly, or Ile
  SITE (467)..(467): Xaa at position 467 is Leu, Ala, Val, Gly, or Ile
  SITE (479)..(479): Xaa at position 479 is Leu, Ala, Val, Gly, or Ile
  SITE (493)..(493): Xaa at position 493 is Trp, Tyr, Phe, Met, His, Ile, Leu Val, Ala, or Gly
  SITE (496)..(496): Xaa at position 496 is Met, Ile, Leu, Val, Ala, or Gly
  SITE (497)..(497): Xaa at position 497 is Ile, Ala, Val, Leu, or Gly
  SITE (500)..(500): Xaa at position 500 is Val, Ala, Gly, Leu, or Ile
  SITE (505)..(505): Xaa at position 505 is Ala, Gly, or Pro
  SITE (506)..(506): Xaa at position 506 is Val, Ala, Gly, Leu, or Ile
  SITE (507)..(507): Xaa at position 507 is Met, Ile, Leu, Val, Ala, or Gly
  SITE (508)..(508): Xaa at position 508 is Ala, Gly, or Pro
  SITE (509)..(509): Xaa at position 509 is Val, Ala, Gly, Leu, or Ile
  SITE (512)..(512): Xaa at position 512 is Leu, Ala, Val, Gly, or Ile
  SITE (522)..(522): Xaa at position 522 is Val, Ala, Gly, Leu, or Ile
  SITE (529)..(529): Xaa at position 529 is Val, Ala, Gly, Leu, or Ile
  SITE (535)..(535): Xaa at position 535 is Val, Ala, Gly, Leu, or Ile
  SITE (536)..(536): Xaa at position 536 is Met, Ile, Leu, Val, Ala, or Gly
  SITE (537)..(537): Xaa at position 537 is Val, Ala, Gly, Leu, or Ile
  SITE (662)..(662): Xaa at position 662 is Val, Ala, Gly, Leu, or Ile
  SITE (665)..(665): Xaa at position 665 is Leu, Ala, Val, Gly, or Ile
  SITE (670)..(670): Xaa at position 670 is Phe, Tyr, Met, His, Ile, Leu, Val Ala, or Gly
  SITE (682)..(682): Xaa at position 682 is Phe, Tyr, Met, His, Ile, Leu, Val Ala, or Gly
  SITE (694)..(694): Xaa at position 694 is Ile, Ala, Val, Leu, or Gly
  SITE (701)..(701): Xaa at position 701 is Met, Ile, Leu, Val, Ala, or Gly
  SITE (705)..(705): Xaa at position 705 is Met, Ile, Leu, Val, Ala, or Gly
  SITE (716)..(716): Xaa at position 716 is Ala, Gly, or Pro
  SITE (727)..(727): Xaa at position 727 is Ala, Gly, or Pro
  SITE (728)..(728): Xaa at position 728 is Phe, Tyr, Met, His, Ile, Leu, Val Ala, or Gly
  SITE (729)..(729): Xaa at position 729 is Ile, Ala, Val, Leu, or Gly
  SITE (732)..(732): Xaa at position 732 is Ala, Gly, or Pro
  SITE (733)..(733): Xaa at position 733 is Ala, Gly, or Pro
  SITE (734)..(734): Xaa at position 734 is Val, Ala, Gly, Leu, or Ile
  SITE (735)..(735): Xaa at position 735 is Leu, Ala, Val, Gly, or Ile
  SITE (761)..(761): Xaa at position 761 is Tyr, Phe, Met, His, Ile, Leu, Val Ala, or Gly
  SITE (763)..(763): Xaa at position 763 is Ile, Ala, Val, Leu, or Gly
  SITE (764)..(764): Xaa at position 764 is Ala, Gly, or Pro
  SITE (765)..(765): Xaa at position 765 is Leu, Ala, Val, Gly, or Ile
  SITE (775)..(775): Xaa at position 775 is Ile, Ala, Val, Leu, or Gly
  SITE (778)..(778): Xaa at position 778 is Ala, Gly, or Pro
  SITE (779)..(779): Xaa at position 779 is Leu, Ala, Val, Gly, or Ile
  SITE (782)..(782): Xaa at position 782 is Phe, Tyr, Met, His, Ile, Leu, Val Ala, or Gly
  SITE (788)..(788): Xaa at position 788 is Met, Ile, Leu, Val, Ala, or Gly
  SITE (791)..(791): Xaa at position 791 is Leu, Ala, Val, Gly, or Ile
  SITE (807)..(807): Xaa at position 807 is Val, Ala, Gly, Leu, or Ile
MGRVGYWTLLVLPALLVWRGPAPSAAAEKGPPALNIAVMLGHSHDVTERELRTLWGPEQAAGLPLDVNVVALLMNRTDPKSLITHVCDLMSGARIHGLVFGDDTDQEAVAQXLDFXSSHTFVPILGIHGGASMIMXDKDPTSTFFQFGASIQQQATVMLKIXQDYDWHVXSLVTTIXPGYREFISFXKTTXDNSFVGWDMQNXITLDTSFEDAKTQXQLKKIHSSVILLYCSKDEAVLILSEARSLGXTGYDFFWIVPSXVSGNTELIPKEFPSGLISVSYDDWDYSLEARXRDGIGILTTAASSMXEKFSYIPEAKASCYGQMERPEVPMHTLHPFMVNVTWDGKDLSFTEEGYQVHPRLVVIVLNKDREWEKVGKWENHTLSLRHAVWPRYKSFSDCEPDDNHLSXXTLEEAPXXIXEDIDPLTETCVRNTVPXRKFXKINNSTNEGMNVKKXXKGXXXDXXKKXSRTVKFTYDLYXVTNGKHGKKVNNVXNGXXGEXVYQRXXXXXGSXTINEERSEVXDFSVPFXETGISXXXSRSNGTVSPSAFLEPFSASVWVMMFVMLLIVSAIAVFVFEYFSPVGYNRNLAKGKAPHGPSFTIGKAIWLLWGLVFNNSVPVQNPKGTTSKIMVSVWAFFAVIFLASYTANLAAFMIQEEFVDQXTGXSDKKXQRPHDYSPPFRXGTVPNGSTERNXRNNYPYXHQYXTKFNQKGVEDXLVSLKTGKLDXXXYDXXXXNYKAGRDEGCKLVTIGSGYIFATTGXGXXXQKGSPWKRQXDLXXLQXVGDGEXEEXETLWLTGICHNEKNEXMSSQLDIDNMAGVFYMLAAAMALSLITFIWEHLFYWKLRFCFTGVCSDRPGLLFSISRGIYSCIHGVHIEEKKKSPDFNLTGSQSNMLKLLRSAKNISSMSNMNSSRMDSPKRAADFIQRGSLIMDMVSDKGNLMYSDNRSFQGKESIFGDNMNELQTFVANRQKDNLNNYVFQGQHPLTLNESNPNTVEVAVSTESKANSRPRQLWKKSVDSIRQDSLSQNPVSQRDEATAENRTHSLKSPRYLPEEMAHSDISETSNRATCHREPDNSKNHKTKDNFKRSVASKYPKDCSEVERTYLKTKSSSPRDKIYTIDGEKEPGFHLDPPQFVENVTLPENVDFPDPYQDPSENFRKGDSTLPMNRNPLHNEEGLSNNDQYKLYSKHFTLKDKGSPHSETSERYRQNSTHCRSCLSNMPTYSGHFTMRSPFKCDACLRMGNLYDIDEDQMLQETGNPATGEQVYQQDWAQNNALQLQKNKLRISRQHSYDNIVDKPRELDLSRPSRSISLKDRERLLEGNFYGSLFSVPSSKLSGKKSSLFPQGLEDSKRSKSLLPDHTSDNPFLHSHRDDQRLVIGRCPSDPYKHSLPSQAVNDSYLRSSLRSTASYCSRDSRGHNDVYISEHVMPYAANKNNMYSTPRVLNSCSNRRVYKKMPSIESDV

SEQ ID NO: 665 - protein, 1108 aa, Homo sapiens
  SITE (1058)..(1058): Xaa at position 1058 is Ala, Gly, or Pro
  SITE (1072)..(1072): Xaa at position 1072 is Phe, Tyr, Met, His, Ile, Leu Val, Ala, or Gly
  SITE (1078)..(1078): Xaa at position 1078 is Ile, Ala, Val, Leu, or Gly
  SITE (1100)..(1100): Xaa at position 1100 is Phe, Tyr, Met, His, Ile, Leu Val, Ala, or Gly
MGSKGVYQYHWQSHNVKHSGVDDMVLLSKITENSIVENLKKRYMDDYIFTYIGSVLISVNPFKQMPYFGEKEIEMYQGAAQYENPPHIYALADNMYRNMIIDRENQCVIISGESGAGKTVAAKYIMSYISRVSGGGTKVQHVKDIILQSNPLLEAFGNAKTVRNNNSSRFGKYFEIQFSPGGEPDGGKISNFLLEKSRVVMRNPGERSFHIFYQLIEGASAEQKHSLGITSMDYYYYLSLSGSYKVDDIDDRREFQETLHAMNVIGIFAEEQTLVLQIVAGILHLGNISFKEVGNYAAVESEEFLAFPAYLLGINQDRLKEKLTSRQMDSKWGGKSESIHVTLNVEQACYTRDALAKALHARVFDFLVDSINKAMEKDHEEYNIGVLDIYGFEIFQKNGFEQFCINFVNEKLQQIFIELTLKAEQEEYVQEGIRWTPIEYFNNKIVCDLIENKVNPPGIMSILDDVCATMHAVGEGADQTLLQKLQMQIGSHEHFNSWNQGFIIHHYAGKVSYDMDGFCERNRDVLFMDLIELMQSSELPFIKSLFPENLQADKKGRPTTAGSKIKKQANDLVSTLMKCTPHYIRCIKPNETKKPRDWEESRVKHQVEYLGLKENIRVRRAGYAYRRIFQKFLQRYAILTKATWPSWQGEEKQGVLHLLQSVNMDSDQFQLGRSKVFIKAPESLFLLEEMRERKYDGYARVIQKSWRKFVARKKYVQMREEASDLLLNKKERRRNSINRNFIGDYIGMEEHPELQQFVGKREKIDFADTVTKYDRRFKGVKRDLLLTPKCLYLIGREKVKQGPDKGLVKEVLKRKIEIERILSVSLSTMQDDIFILHEQEYDSLLESVFKTEFLSLLAKRYEEKTQKQLPLKFSNTLELKLKKENWGPWSAGGSRQVQFHQGFGDLAVLKPSNKVLQVSIGPGLPKNSRPTRRNTTQNTGYSSGTQNANYPVRAAPPPPGYHQNGVIRNQYVPYPHAPGSQRSNQKSLYTSMARPPLPRQQSTSSDRVSQTPESLDFLKVPDQGAAGVRRQTTSRPPPAGGRPKPQPKPKPQVPQCKXLYAYDAQDTDELSXNANDIXDIIKEDPSGWWTGRLRGKQGLXPNNYVTKI

SEQ ID NO: 666 - protein, 908 aa, Homo sapiens
  SITE (36)..(36): Xaa at position 36 is Leu, Ala, Val, Gly, or Ile
  SITE (38)..(38): Xaa at position 38 is Phe, Tyr, Met, His, Ile, Leu, Val Ala, or Gly
  SITE (41)..(41): Xaa at position 41 is Ile, Ala, Val, Leu, or Gly
  SITE (56)..(56): Xaa at position 56 is Ala, Gly, or Pro
  SITE (57)..(57): Xaa at position 57 is Phe, Tyr, Met, His, Ile, Leu, Val Ala, or Gly
  SITE (60)..(60): Xaa at position 60 is Ala, Gly, or Pro
  SITE (61)..(61): Xaa at position 61 is Val, Ala, Gly, Leu, or Ile
  SITE (64)..(64): Xaa at position 64 is Ile, Ala, Val, Leu, or Gly
  SITE (71)..(71): Xaa at position 71 is Leu, Ala, Val, Gly, or Ile
  SITE (83)..(83): Xaa at position 83 is Ile, Ala, Val, Leu, or Gly
  SITE (91)..(91): Xaa at position 91 is Ala, Gly, or Pro
  SITE (95)..(95): Xaa at position 95 is Ala, Gly, or Pro
  SITE (99)..(99): Xaa at position 99 is Leu, Ala, Val, Gly, or Ile
  SITE (103)..(103): Xaa at position 103 is Val, Ala, Gly, Leu, or Ile
  SITE (104)..(104): Xaa at position 104 is Ala, Gly, or Pro
  SITE (105)..(105): Xaa at position 105 is Ala, Gly, or Pro
  SITE (106)..(106): Xaa at position 106 is Ile, Ala, Val, Leu, or Gly
  SITE (107)..(107): Xaa at position 107 is Phe, Tyr, Met, His, Ile, Leu, Val Ala, or Gly
  SITE (115)..(115): Xaa at position 115 is Ala, Gly, or Pro
  SITE (118)..(118): Xaa at position 118 is Val, Ala, Gly, Leu, or Ile
  SITE (122)..(122): Xaa at position 122 is Cys, Ala, Val, Gly, Ser, or Thr
  SITE (127)..(127): Xaa at position 127 is Val, Ala, Gly, Leu, or Ile
  SITE (129)..(129): Xaa at position 129 is His, Phe, Tyr, Lys, Arg, Gly, Ser Thr, Ala, Val, Leu, Ile, Asn, Met, or Gln
  SITE (130)..(130): Xaa at position 130 is Ile, Ala, Val, Leu, or Gly
  SITE (147)..(147): Xaa at position 147 is Val, Ala, Gly, Leu, or Ile
  SITE (149)..(149): Xaa at position 149 is Leu, Ala, Val, Gly, or Ile
  SITE (153)..(153): Xaa at position 153 is Phe, Tyr, Met, His, Ile, Leu, Val Ala, or Gly
  SITE (156)..(156): Xaa at position 156 is Leu, Ala, Val, Gly, or Ile
  SITE (159)..(159): Xaa at position 159 is Ala, Gly, or Pro
  SITE (160)..(160): Xaa at position 160 is Ile, Ala, Val, Leu, or Gly
  SITE (163)..(163): Xaa at position 163 is Leu, Ala, Val, Gly, or Ile
  SITE (164)..(164): Xaa at position 164 is Val, Ala, Gly, Leu, or Ile
  SITE (172)..(172): Xaa at position 172 is Val, Ala, Gly, Leu, or Ile
  SITE (174)..(174): Xaa at position 174 is Val, Ala, Gly, Leu, or Ile
  SITE (175)..(175): Xaa at position 175 is Val, Ala, Gly, Leu, or Ile
  SITE (185)..(185): Xaa at position 185 is Leu, Ala, Val, Gly, or Ile
  SITE (188)..(188): Xaa at position 188 is Leu, Ala, Val, Gly, or Ile
  SITE (191)..(191): Xaa at position 191 is Ala, Gly, or Pro
  SITE (197)..(197): Xaa at position 197 is Leu, Ala, Val, Gly, or Ile
  SITE (204)..(204): Xaa at position 204 is Leu, Ala, Val, Gly, or Ile
  SITE (211)..(211): Xaa at position 211 is Ala, Gly, or Pro
  SITE (215)..(215): Xaa at position 215 is Leu, Ala, Val, Gly, or Ile
  SITE (218)..(218): Xaa at position 218 is Met, Ile, Leu, Val, Ala, or Gly
  SITE (226)..(226): Xaa at position 226 is Val, Ala, Gly, Leu, or Ile
  SITE (227)..(227): Xaa at position 227 is Ile, Ala, Val, Leu, or Gly
  SITE (228)..(228): Xaa at position 228 is Phe, Tyr, Met, His, Ile, Leu, Val Ala, or Gly
  SITE (235)..(235): Xaa at position 235 is Ala, Gly, or Pro
  SITE (236)..(236): Xaa at position 236 is Ala, Gly, or Pro
  SITE (238)..(238): Xaa at position 238 is Ile, Ala, Val, Leu, or Gly
  SITE (239)..(239): Xaa at position 239 is Leu, Ala, Val, Gly, or Ile
  SITE (242)..(242): Xaa at position 242 is Ala, Gly, or Pro
  SITE (247)..(247): Xaa at position 247 is Met, Ile, Leu, Val, Ala, or Gly
  SITE (254)..(254): Xaa at position 254 is Tyr, Phe, Met, His, Ile, Leu, Val Ala, or Gly
  SITE (255)..(255): Xaa at position 255 is Ile, Ala, Val, Leu, or Gly
  SITE (256)..(256): Xaa at position 256 is Phe, Tyr, Met, His, Ile, Leu, Val Ala, or Gly
  SITE (259)..(259): Xaa at position 259 is Leu, Ala, Val, Gly, or Ile
  SITE (261)..(261): Xaa at position 261 is Leu, Ala, Val, Gly, or Ile
  SITE (264)..(264): Xaa at position 264 is Leu, Ala, Val, Gly, or Ile
  SITE (276)..(276): Xaa at position 276 is Met, Ile, Leu, Val, Ala, or Gly
  SITE (279)..(279): Xaa at position 279 is Phe, Tyr, Met, His, Ile, Leu, Val Ala, or Gly
  SITE (282)..(282): Xaa at position 282 is Leu, Ala, Val, Gly, or Ile
  SITE (296)..(296): Xaa at position 296 is Trp, Tyr, Phe, Met, His, Ile, Leu Val, Ala, or Gly
  SITE (316)..(316): Xaa at position 316 is Met, Ile, Leu, Val, Ala, or Gly
  SITE (320)..(320): Xaa at position 320 is Ala, Gly, or Pro
  SITE (321)..(321): Xaa at position 321 is Ala, Gly, or Pro
  SITE (322)..(322): Xaa at position 322 is Leu, Ala, Val, Gly, or Ile
  SITE (323)..(323): Xaa at position 323 is Met, Ile, Leu, Val, Ala, or Gly
  SITE (326)..(326): Xaa at position 326 is Ala, Gly, or Pro
  SITE (327)..(327): Xaa at position 327 is Val, Ala, Gly, Leu, or Ile
  SITE (329)..(329): Xaa at position 329 is Val, Ala, Gly, Leu, or Ile
  SITE (330)..(330): Xaa at position 330 is Val, Ala, Gly, Leu, or Ile
  SITE (333)..(333): Xaa at position 333 is Ala, Gly, or Pro
  SITE (340)..(340): Xaa at position 340 is Met, Ile, Leu, Val, Ala, or Gly
  SITE (345)..(345): Xaa at position 345 is Leu, Ala, Val, Gly, or Ile
  SITE (353)..(353): Xaa at position 353 is Trp, Tyr, Phe, Met, His, Ile, Leu Val, Ala, or Gly
  SITE (359)..(359): Xaa at position 359 is Phe, Tyr, Met, His, Ile, Leu, Val Ala, or Gly
  SITE (363)..(363): Xaa at position 363 is Ile, Ala, Val, Leu, or Gly
  SITE (366)..(366): Xaa at position 366 is Ala, Gly, or Pro
  SITE (375)..(375): Xaa at position 375 is Ile, Ala, Val, Leu, or Gly
  SITE (387)..(387): Xaa at position 387 is Phe, Tyr, Met, His, Ile, Leu, Val Ala, or Gly
  SITE (389)..(389): Xaa at position 389 is Leu, Ala, Val, Gly, or Ile
  SITE (391)..(391): Xaa at position 391 is Val, Ala, Gly, Leu, or Ile
  SITE (392)..(392): Xaa at position 392 is Ile, Ala, Val, Leu, or Gly
  SITE (405)..(405): Xaa at position 405 is Trp, Tyr, Phe, Met, His, Ile, Leu Val, Ala, or Gly
  SITE (433)..(433): Xaa at position 433 is Leu, Ala, Val, Gly, or Ile
  SITE (434)..(434): Xaa at position 434 is Ile, Ala, Val, Leu, or Gly
  SITE (435)..(435): Xaa at position 435 is Val, Ala, Gly, Leu, or Ile
  SITE (443)..(443): Xaa at position 443 is Tyr, Phe, Met, His, Ile, Leu, Val Ala, or Gly
  SITE (444)..(444): Xaa at position 444 is Val, Ala, Gly, Leu, or Ile
  SITE (446)..(446): Xaa at position 446 is Phe, Tyr, Met, His, Ile, Leu, Val Ala, or Gly
  SITE (453)..(453): Xaa at position 453 is Leu, Ala, Val, Gly, or Ile
  SITE (459)..(459): Xaa at position 459 is Phe, Tyr, Met, His, Ile, Leu, Val Ala, or Gly
  SITE (462)..(462): Xaa at position 462 is Tyr, Phe, Met, His, Ile, Leu, Val Ala, or Gly
  SITE (463)..(463): Xaa at position 463 is Cys, Ala, Val, Gly, Ser, or Thr
  SITE (464)..(464): Xaa at position 464 is Ile, Ala, Val, Leu, or Gly
  SITE (466)..(466): Xaa at position 466 is Leu, Ala, Val, Gly, or Ile
  SITE (467)..(467): Xaa at position 467 is Leu, Ala, Val, Gly, or Ile
  SITE (470)..(470): Xaa at position 470 is Leu, Ala, Val, Gly, or Ile
  SITE (480)..(480): Xaa at position 480 is Ile, Ala, Val, Leu, or Gly
  SITE (490)..(490): Xaa at position 490 is Ala, Gly, or Pro
  SITE (501)..(501): Xaa at position 501 is Met, Ile, Leu, Val, Ala, or Gly
  SITE (502)..(502): Xaa at position 502 is Val, Ala, Gly, Leu, or Ile
  SITE (505)..(505): Xaa at position 505 is Leu, Ala, Val, Gly, or Ile
  SITE (510)..(510): Xaa at position 510 is Ala, Gly, or Pro
  SITE (512)..(512): Xaa at position 512 is Leu, Ala, Val, Gly, or Ile
  SITE (513)..(513): Xaa at position 513 is Ala, Gly, or Pro
  SITE (514)..(514): Xaa at position 514 is Val, Ala, Gly, Leu, or Ile
  SITE (515)..(515): Xaa at position 515 is Ala, Gly, or Pro
  SITE (517)..(517): Xaa at position 517 is Leu, Ala, Val, Gly, or Ile
  SITE (518)..(518): Xaa at position 518 is Ala, Gly, or Pro
  SITE (527)..(527): Xaa at position 527 is Ile, Ala, Val, Leu, or Gly
  SITE (533)..(533): Xaa at position 533 is Phe, Tyr, Met, His, Ile, Leu, Val Ala, or Gly
  SITE (536)..(536): Xaa at position 536 is Leu, Ala, Val, Gly, or Ile
  SITE (538)..(538): Xaa at position 538 is Ile, Ala, Val, Leu, or Gly
  SITE (540)..(540): Xaa at position 540 is Ile, Ala, Val, Leu, or Gly
  SITE (541)..(541): Xaa at position 541 is Leu, Ala, Val, Gly, or Ile
  SITE (542)..(542): Xaa at position 542 is Tyr, Phe, Met, His, Ile, Leu, Val Ala, or Gly
  SITE (674)..(674): Xaa at position 674 is Leu, Ala, Val, Gly, or Ile
  SITE (675)..(675): Xaa at position 675 is Ala, Gly, or Pro
  SITE (680)..(680): Xaa at position 680 is Ile, Ala, Val, Leu, or Gly
  SITE (682)..(682): Xaa at position 682 is Tyr, Phe, Met, His, Ile, Leu, Val Ala, or Gly
  SITE (684)..(684): Xaa at position 684 is Ala, Gly, or Pro
  SITE (691)..(691): Xaa at position 691 is Met, Ile, Leu, Val, Ala, or Gly
  SITE (694)..(694): Xaa at position 694 is Phe, Tyr, Met, His, Ile, Leu, Val Ala, or Gly
  SITE (705)..(705): Xaa at position 705 is Met, Ile, Leu, Val, Ala, or Gly
  SITE (709)..(709): Xaa at position 709 is Met, Ile, Leu, Val, Ala, or Gly
  SITE (716)..(716): Xaa at position 716 is Val, Ala, Gly, Leu, or Ile
  SITE (718)..(718): Xaa at position 718 is Val, Ala, Gly, Leu, or Ile
  SITE (728)..(728): Xaa at position 728 is Val, Ala, Gly, Leu, or Ile
  SITE (733)..(733): Xaa at position 733 is Tyr, Phe, Met, His, Ile, Leu, Val Ala, or Gly
  SITE (734)..(734): Xaa at position 734 is Ala, Gly, or Pro
  SITE (735)..(735): Xaa at position 735 is Phe, Tyr, Met, His, Ile, Leu, Val Ala, or Gly
  SITE (736)..(736): Xaa at position 736 is Leu, Ala, Val, Gly, or Ile
  SITE (737)..(737): Xaa at position 737 is Met, Ile, Leu, Val, Ala, or Gly
  SITE (742)..(742): Xaa at position 742 is Ile, Ala, Val, Leu, or Gly
  SITE (752)..(752): Xaa at position 752 is Leu, Ala, Val, Gly, or Ile
  SITE (764)..(764): Xaa at position 764 is Tyr, Phe, Met, His, Ile, Leu, Val Ala, or Gly
  SITE (766)..(766): Xaa at position 766 is Val, Ala, Gly, Leu, or Ile
  SITE (778)..(778): Xaa at position 778 is Ile, Ala, Val, Leu, or Gly
  SITE (781)..(781): Xaa at position 781 is Ala, Gly, or Pro
  SITE (782)..(782): Xaa at position 782 is Ile, Ala, Val, Leu, or Gly
  SITE (785)..(785): Xaa at position 785 is Leu, Ala, Val, Gly, or Ile
  SITE (791)..(791): Xaa at position 791 is Leu, Ala, Val, Gly, or Ile
  SITE (794)..(794): Xaa at position 794 is Met, Ile, Leu, Val, Ala, or Gly
  SITE (799)..(799): Xaa at position 799 is Trp, Tyr, Phe, Met, His, Ile, Leu Val, Ala, or Gly
MKIIFPILSNPVFRRTVKLLLCLLWIGYSQGTTHVXRXGGXFEYVESGPMGAEELXXRFXXNTXNRNRTLXPNTTLTYDTQKXNLYDSFEXSKKXCDQXSLGXXXXXGPSHSSSXNAXQSIXNALGXPXXQTRWKHQVSDNKDSFYXSXYPDXSSXSRXXLDXXQFFKWKTXTXXYDDSTGLIRXQEXIKXPSRYNXRLKIRQXPADTKDXKPLXKEXKRGKEFHXXXDCSHEMXXGXXKQXLAMGXMTEYYHXXXTTXDXFAXDVEPYRYSGVNXTGXRIXNTENTQVSSIIEKXSMERLQAPPKPDSGLLDGFXTTDXXXXYDXXHXXSVXVQQFPQXTVSSXQCNRHKPXRFGTRXMSLXKEXHWEGLTGRXTFNKTNGLRTDXDXDXXSLKEEGLEKIGTXDPASGLNMTESQKGKPANITDSLSNRSXXXTTILEEPXXLXKKSDKPXYGNDRXEGXXXDXXREXSTILGFTYEXRLVEDGKYGXQDDANGQWNGXXREXIDHKXDXXXXPXXITYVREKVXDFSKPXMTXGXSXXXRKPNGTNPGVFSFLNPLSPDIWMYILLAYLGVSCVLFVIARFSPYEWYNPHPCNPDSDVVENNFTLLNSFWFGVGALMQQGSELMPKALSTRIVGGIWWFFTLIIISSYTANLAAFLTVERMESPIDSADDXXKQTKXEXGXVEDGATXTFXKKSKISTYDKXWAFXSSRRQSXLXKSNEEGIQRXLTSDXXXXXESTTXEFVTQRNCNXTQIGGLIDSKGXGXGTPMGSPYRDKXTIXXLQXQEEGKXHMXKEKWXRGNGCPEEESKEASALGVQNIGGIFIVLAAGLVLSVFVAVGEFLYKSKKNAQLEKRSFCSAMVEELRMSLKCQRRLKHKPQAPVIVKTEEVINMHTFNDRRLPGKETMA

SEQ ID NO: 667 - protein, 1591 aa, Homo sapiens
  SITE (440)..(440): Xaa at position 440 is Leu, Ala, Val, Gly, or Ile
  SITE (441)..(441): Xaa at position 441 is Ala, Gly, or Pro
  SITE (446)..(446): Xaa at position 446 is Leu, Ala, Val, Gly, or Ile
  SITE (454)..(454): Xaa at position 454 is Val, Ala, Gly, Leu, or Ile
  SITE (467)..(467): Xaa at position 467 is Val, Ala, Gly, Leu, or Ile
  SITE (469)..(469): Xaa at position 469 is Leu, Ala, Val, Gly, or Ile
  SITE (474)..(474): Xaa at position 474 is Leu, Ala, Val, Gly, or Ile
  SITE (476)..(476): Xaa at position 476 is Phe, Tyr, Met, His, Ile, Leu, Val Ala, or Gly
  SITE (497)..(497): Xaa at position 497 is Val, Ala, Gly, Leu, or Ile
  SITE (501)..(501): Xaa at position 501 is Ile, Ala, Val, Leu, or Gly
  SITE (502)..(502): Xaa at position 502 is Val, Ala, Gly, Leu, or Ile
  SITE (514)..(514): Xaa at position 514 is Val, Ala, Gly, Leu, or Ile
  SITE (515)..(515): Xaa at position 515 is Phe, Tyr, Met, His, Ile, Leu, Val Ala, or Gly
  SITE (516)..(516): Xaa at position 516 is Cys, Ala, Val, Gly, Ser, or Thr
  SITE (517)..(517): Xaa at position 517 is Leu, Ala, Val, Gly, or Ile
  SITE (524)..(524): Xaa at position 524 is Ala, Gly, or Pro
  SITE (527)..(527): Xaa at position 527 is Phe, Tyr, Met, His, Ile, Leu, Val Ala, or Gly
  SITE (535)..(535): Xaa at position 535 is Leu, Ala, Val, Gly, or Ile
  SITE (538)..(538): Xaa at position 538 is Trp, Tyr, Phe, Met, His, Ile, Leu Val, Ala, or Gly
  SITE (542)..(542): Xaa at position 542 is Ile, Ala, Val, Leu, or Gly
  SITE (543)..(543): Xaa at position 543 is His, Phe, Tyr, Lys, Arg, Gly, Ser Thr, Ala, Val, Leu, Ile, Asn, Met, or Gln
  SITE (545)..(545): Xaa at position 545 is Ala, Gly, or Pro
  SITE (546)..(546): Xaa at position 546 is Cys, Ala, Val, Gly, Ser, or Thr
  SITE (547)..(547): Xaa at position 547 is Ala, Gly, or Pro
  SITE (551)..(551): Xaa at position 551 is Ala, Gly, or Pro
  SITE (563)..(563): Xaa at position 563 is Leu, Ala, Val, Gly, or Ile
  SITE (616)..(616): Xaa at position 616 is Met, Ile, Leu, Val, Ala, or Gly
  SITE (623)..(623): Xaa at position 623 is Cys, Ala, Val, Gly, Ser, or Thr
  SITE (624)..(624): Xaa at position 624 is Tyr, Phe, Met, His, Ile, Leu, Val Ala, or Gly
  SITE (639)..(639): Xaa at position 639 is Leu, Ala, Val, Gly, or Ile
  SITE (651)..(651): Xaa at position 651 is Met, Ile, Leu, Val, Ala, or Gly
  SITE (662)..(662): Xaa at position 662 is Phe, Tyr, Met, His, Ile, Leu, Val Ala, or Gly
  SITE (664)..(664): Xaa at position 664 is Ala, Gly, or Pro
  SITE (666)..(666): Xaa at position 666 is Val, Ala, Gly, Leu, or Ile
  SITE (667)..(667): Xaa at position 667 is Ala, Gly, or Pro
  SITE (668)..(668): Xaa at position 668 is Ala, Gly, or Pro
  SITE (848)..(848): Xaa at position 848 is Ile, Ala, Val, Leu, or Gly
  SITE (858)..(858): Xaa at position 858 is Tyr, Phe, Met, His, Ile, Leu, Val Ala, or Gly
  SITE (873)..(873): Xaa at position 873 is Leu, Ala, Val, Gly, or Ile
  SITE (884)..(884): Xaa at position 884 is Ala, Gly, or Pro
  SITE (895)..(895): Xaa at position 895 is Ile, Ala, Val, Leu, or Gly
  SITE (898)..(898): Xaa at position 898 is Ile, Ala, Val, Leu, or Gly
  SITE (903)..(903): Xaa at position 903 is Ala, Gly, or Pro
  SITE (906)..(906): Xaa at position 906 is Leu, Ala, Val, Gly, or Ile
  SITE (920)..(920): Xaa at position 920 is Leu, Ala, Val, Gly, or Ile
  SITE (924)..(924): Xaa at position 924 is Val, Ala, Gly, Leu, or Ile
MGNAESQHVEHEFYGEKHASLGRKHTSRSLRLSHKTRRTRHASSGKVIHRNSEVSTRSSSTPSIPQSLAENGLEPFSQDGTLEDFGSPIWVDRVDMGLRPVSYTDSSVTPSVDSSIVLTAASVQSMPDTEESRLYGDDATYLAEGGRRQHSYTSNGPTFMETASFKKKRSKSADIWREDSLEFSLSDLSQEHLTSNEEILGSAEEKDCEEARGMETRASPRQLSTCQRANSLGDLYAQKNSGVTANGGPGSKFAGYCRNLVSDIPNLANHKMPPAAAEETPPYSNYNTLPCRKSHCLSEGATNPQISHSNSMQGRRAKTTQDVNAGEGSEFADSGIEGATTDTDLLSRRSNATNSSYSPTTGRAFVGSDSGSSSTGDAARQGVYENFRRELEMSTTNSESLEEAGSAHSDEQSSGTLSSPGQSDILLTAAQGTVRKAGAXXVKNFXVHKKNKKXESATRRKWKHYWXSXKGCTXFXYESDGRSGIDHNSIPKHAVWXENSXXQAVPEHPKKDFXXXXSNSLGDXFLXQTTSQTEXENXITAXXSXXXTAVXRHHHKEDTLRLXKSEIKKLEQKIDMDEKMKKMGEMQLSSVTDSKKKKTILDQIFVWEQNLEQFQXDLFRFRXXLASLQGGELPNPKRXLAFASRPTKVAXGRLGIFSVSSXHXLXXXRTGETGVRRRTQAMSRSASKRRSRFSSLWGLDTTSKKKQGRPSINQVFGEGTEAVKKSLEGIFDDIVPDGKREKEVVLPNVHQHNPDCDIWVHEYFTPSWFCLPNNQPALTVVRPGDTARDTLELICKTHQLDHSAHYLRLKFLIENKMQLYVPQPEEDIYELLYKEIEICPKVTQSIHXEKSDTAADTXGFSLSSVEEDGIRRXYVNSVKETGLXSKKGLKAGDEXLEXNNRAXDAXNSSMLKDFLSQPSXGLLXRTYPELEEGVELLESPPHRVDGPADLGESPLAFLTSNPGHSLCSEQGSSAETAPEETEGPDLESSDETDHSSKSTEQVAAFCRSLHEMNPSDQSPSPQDSTGPQLATMRQLSDADKLRKVICELLETERTYVKDLNCLMERYLKPLQKETFLTQDELDVLFGNLTEMVEFQVEFLKTLEDGVRLVPDLEKLEKVDQFKKVLFSLGGSFLYYADRFKLYSAFCASHTKVPKVLVKAKTDTAFKAFLDAQNPKQQHSSTLESYLIKPIQRILKYPLLLRELFALTDAESEEHYHLDVAIKTMNKVASHINEMQKIHEEFGAVFDQLIAEQTGEKKEVADLSMGDLLLHTTVIWLNPPASLGKWKKEPELAAFVFKTAVVLVYKDGSKQKKKLVGSHRLSIYEDWDPFRFRHMIPTEALQVRALASADAEANAVCEIVHVKSESEGRPERVFHLCCSSPESRKDFLKAVHSILRDKHRRQLLKTESLPSSQQYVPFGGKRLCALKGARPAMSRAVSAPSKSLGRRRRRLARNRFTIDSDAVSASSPEKESQQPPGGGDTDRWVEEQFDLAQYEEQDDIKETDILSDDDEFCESVKGASVDRDLQERLQATSISQRERGRKTLDSHASRMAQLKKQAALSGINGGLESASEEVIWVRREDFAPSRKLNTEI

SEQ ID NO: 668 - protein, 1463 aa, Homo sapiens
  SITE (182)..(182): Xaa at position 182 is Phe, Tyr, Met, His, Ile, Leu, Val Ala, or Gly
  SITE (204)..(204): Xaa at position 204 is Cys, Ala, Val, Gly, Ser, or Thr
  SITE (219)..(219): Xaa at position 219 is Cys, Ala, Val, Gly, Ser, or Thr
MLLSPSLLLLLLLGAPRGCAEGVAAALTPERLLEWQDKGIFVIQSESLKKCIQAGKSVLTLENCKQANKHMLWKWVSNHGLFNIGGSGCLGLNFSAPEQPLSLYECDSTLVSLRWRCNRKMITGPLQYSVQVAHDNTVVASRKYIHKWISYGSGGGDICEYLHKDLHTIKGNTHGMPCMFPXQYNHQWHHECTREGREDDLLWXATTSRYERDEKWGFXPDPTSAEVGCDTIWEKDLNSHICYQFNLLSSLSWSEAHSSCQMQGGTLLSITDETEENFIREHMSSKTVEVWMGLNQLDEHAGWQWSDGTPLNYLNWSPEVNFEPFVEDHCGTFSSFMPSAWRSRDCESTLPYICKKYLNHIDHEIVEKDAWKYYATHCEPGWNPYNRNCYKLQKEEKTWHEALRSCQADNSALIDITSLAEVEFLVTLLGDENASETWIGLSSNKIPVSFEWSNDSSVIFTNWHTLEPHIFPNRSQLCVSAEQSEGHWKVKNCEERLFYICKKAGHVLSDAESGCQEGWERHGGFCYKIDTVLRSFDQASSGYYCPPALVTITNRFEQAFITSLISSVVKMKDSYFWIALQDQNDTGEYTWKPVGQKPEPVQYTHWNTHQPRYSGGCVAMRGRHPLGRWEVKHCRHFKAMSLCKQPVENQEKAEYEERWPFHPCYLDWESEPGLASCFKVFHSEKVLMKRTWREAEAFCEEFGAHLASFAHIEEENFVNELLHSKFNWTEERQFWIGFNKRNPLNAGSWEWSDRTPVVSSFLDNTYFGEDARNCAVYKANKTLLPLHCGSKREWICKIPRDVKPKIPFWYQYDVPWLFYQDAEYLFHTFASEWLNFEFVCSWLHSDLLTIHSAHEQEFIHSKIKALSKYGASWWIGLQEERANDEFRWRDGTPVIYQNWDTGRERTVNNQSQRCGFISSITGLWGSEECSVSMPSICKRKKVWLIEKKKDTPKQHGTCPKGWLYFNYKCLLLNIPKDPSSWKNWTHAQHFCAEEGGTLVAIESEVEQAFITMNLFGQTTSVWIGLQNDDYETWLNGKPVVYSNWSPFDIINIPSHNTTEVQKHIPLCALLSSNPNFHFTGKWYFEDCGKEGYGFVCEKMQDTSGHGVNTSDMYPMPNTLEYGNRTYKIINANMTWYAAIKTCLMHKAQLVSITDQYHQSFLTVVLNRLGYAHWIGLFTTDNGLNFDWSDGTKSSFTFWKDEESSLLGDCVFADSNGRWHSTACESFLQGAICHVPPETRQSEHPELCSETSIPWIKFKSNCYSFSTVLDSMSFEAAHEFCKKEGSNLLTIKDEAENAFLLEELFAFGSSVQMVWLNAQFDGNNETIKWFDGTPTDQSNWGIRKPDTDYFKPHHCVALRIPEGLWQLSPCQEKKGFICKMEADIHTAEALPEKGPSHSIIPLAVVLTLIVIVAICTLSFCIYKHNGGFFRRLAGFRNPYYPATNFSTVYLEENILISDLEKSDQ

SEQ ID NO: 669 - protein, 441 aa, Homo sapiens
  SITE (56)..(56): Xaa at position 56 is Ile, Ala, Val, Leu, or Gly
  SITE (67)..(67): Xaa at position 67 is Cys, Ala, Val, Gly, Ser, or Thr
  SITE (71)..(71): Xaa at position 71 is Met, Ile, Leu, Val, Ala, or Gly
  SITE (80)..(80): Xaa at position 80 is Phe, Tyr, Met, His, Ile, Leu, Val Ala, or Gly
  SITE (81)..(81): Xaa at position 81 is Leu, Ala, Val, Gly, or Ile
  SITE (84)..(84): Xaa at position 84 is Tyr, Phe, Met, His, Ile, Leu, Val Ala, or Gly
  SITE (85)..(85): Xaa at position 85 is Tyr, Phe, Met, His, Ile, Leu, Val Ala, or Gly
  SITE (97)..(97): Xaa at position 97 is Trp, Tyr, Phe, Met, His, Ile, Leu Val, Ala, or Gly
  SITE (98)..(98): Xaa at position 98 is Ile, Ala, Val, Leu, or Gly
  SITE (103)..(103): Xaa at position 103 is Tyr, Phe, Met, His, Ile, Leu, Val Ala, or Gly
  SITE (111)..(111): Xaa at position 111 is Leu, Ala, Val, Gly, or Ile
  SITE (116)..(116): Xaa at position 116 is Leu, Ala, Val, Gly, or Ile
  SITE (117)..(117): Xaa at position 117 is Met, Ile, Leu, Val, Ala, or Gly
  SITE (124)..(124): Xaa at position 124 is Leu, Ala, Val, Gly, or Ile
  SITE (125)..(125): Xaa at position 125 is Phe, Tyr, Met, His, Ile, Leu, Val Ala, or Gly
  SITE (132)..(132): Xaa at position 132 is Ala, Gly, or Pro
  SITE (144)..(144): Xaa at position 144 is Tyr, Phe, Met, His, Ile, Leu, Val Ala, or Gly
  SITE (146)..(146): Xaa at position 146 is Leu, Ala, Val, Gly, or Ile
  SITE (147)..(147): Xaa at position 147 is Val, Ala, Gly, Leu, or Ile
  SITE (148)..(148): Xaa at position 148 is Val, Ala, Gly, Leu, or Ile
  SITE (151)..(151): Xaa at position 151 is His, Phe, Tyr, Lys, Arg, Gly, Ser Thr, Ala, Val, Leu, Ile, Asn, Met, or Gln
  SITE (156)..(156): Xaa at position 156 is Phe, Tyr, Met, His, Ile, Leu, Val Ala, or Gly
  SITE (165)..(165): Xaa at position 165 is Ile, Ala, Val, Leu, or Gly
  SITE (168)..(168): Xaa at position 168 is Ala, Gly, or Pro
  SITE (172)..(172): Xaa at position 172 is Phe, Tyr, Met, His, Ile, Leu, Val Ala, or Gly
  SITE (173)..(173): Xaa at position 173 is Ile, Ala, Val, Leu, or Gly
  SITE (175)..(175): Xaa at position 175 is Ala, Gly, or Pro
  SITE (179)..(179): Xaa at position 179 is His, Phe, Tyr, Lys, Arg, Gly, Ser Thr, Ala, Val, Leu, Ile, Asn, Met, or Gln
  SITE (184)..(184): Xaa at position 184 is Ala, Gly, or Pro
  SITE (186)..(186): Xaa at position 186 is Ala, Gly, or Pro
  SITE (189)..(189): Xaa at position 189 is Tyr, Phe, Met, His, Ile, Leu, Val Ala, or Gly
  SITE (222)..(222): Xaa at position 222 is Val, Ala, Gly, Leu, or Ile
  SITE (226)..(226): Xaa at position 226 is Ala, Gly, or Pro
  SITE (229)..(229): Xaa at position 229 is Cys, Ala, Val, Gly, Ser, or Thr
  SITE (232)..(232): Xaa at position 232 is Ala, Gly, or Pro
  SITE (233)..(233): Xaa at position 233 is Leu, Ala, Val, Gly, or Ile
  SITE (239)..(239): Xaa at position 239 is Ile, Ala, Val, Leu, or Gly
  SITE (267)..(267): Xaa at position 267 is Ile, Ala, Val, Leu, or Gly
  SITE (268)..(268): Xaa at position 268 is Ala, Gly, or Pro
  SITE (269)..(269): Xaa at position 269 is Val, Ala, Gly, Leu, or Ile
  SITE (270)..(270): Xaa at position 270 is Ile, Ala, Val, Leu, or Gly
  SITE (277)..(277): Xaa at position 277 is Ala, Gly, or Pro
  SITE (279)..(279): Xaa at position 279 is Val, Ala, Gly, Leu, or Ile
  SITE (280)..(280): Xaa at position 280 is Ile, Ala, Val, Leu, or Gly
  SITE (283)..(283): Xaa at position 283 is Leu, Ala, Val, Gly, or Ile
  SITE (289)..(289): Xaa at position 289 is Phe, Tyr, Met, His, Ile, Leu, Val Ala, or Gly
  SITE (291)..(291): Xaa at position 291 is Cys, Ala, Val, Gly, Ser, or Thr
  SITE (293)..(293): Xaa at position 293 is Ile, Ala, Val, Leu, or Gly
  SITE (294)..(294): Xaa at position 294 is Ala, Gly, or Pro
  SITE (297)..(297): Xaa at position 297 is Ala, Gly, or Pro
  SITE (299)..(299): Xaa at position 299 is Met, Ile, Leu, Val, Ala, or Gly
  SITE (306)..(306): Xaa at position 306 is Val, Ala, Gly, Leu, or Ile
  SITE (310)..(310): Xaa at position 310 is Ile, Ala, Val, Leu, or Gly
  SITE (314)..(314): Xaa at position 314 is Leu, Ala, Val, Gly, or Ile
  SITE (315)..(315): Xaa at position 315 is Phe, Tyr, Met, His, Ile, Leu, Val Ala, or Gly
  SITE (316)..(316): Xaa at position 316 is Phe, Tyr, Met, His, Ile, Leu, Val Ala, or Gly
  SITE (317)..(317): Xaa at position 317 is Ile, Ala, Val, Leu, or Gly
  SITE (328)..(328): Xaa at position 328 is Ile, Ala, Val, Leu, or Gly
  SITE (331)..(331): Xaa at position 331 is Met, Ile, Leu, Val, Ala, or Gly
  SITE (334)..(334): Xaa at position 334 is Cys, Ala, Val, Gly, Ser, or Thr
  SITE (344)..(344): Xaa at position 344 is Ile, Ala, Val, Leu, or Gly
  SITE (354)..(354): Xaa at position 354 is Phe, Tyr, Met, His, Ile, Leu, Val Ala, or Gly
  SITE (357)..(357): Xaa at position 357 is Phe, Tyr, Met, His, Ile, Leu, Val Ala, or Gly
  SITE (380)..(380): Xaa at position 380 is Ala, Gly, or Pro
  SITE (387)..(387): Xaa at position 387 is Ala, Gly, or Pro
  SITE (389)..(389): Xaa at position 389 is Leu, Ala, Val, Gly, or Ile
  SITE (390)..(390): Xaa at position 390 is Ala, Gly, or Pro
  SITE (391)..(391): Xaa at position 391 is Phe, Tyr, Met, His, Ile, Leu, Val Ala, or Gly
  SITE (392)..(392): Xaa at position 392 is Leu, Ala, Val, Gly, or Ile
  SITE (402)..(402): Xaa at position 402 is Phe, Tyr, Met, His, Ile, Leu, Val Ala, or Gly
  SITE (422)..(422): Xaa at position 422 is Ile, Ala, Val, Leu, or Gly
MVPPKLHVLFCLCGCLAVVYPFDWQYINPVAHMKSSAWVNKIQVLMAAASFGQTKXPRGNGPYSVGXTDLXFDHTNKGTXXRLXXPSQDNDRLDTLXXPNKEXFWGLSKFXGTHWXXGNILRLXXGSMTTPXNWNSPLRPGEKXPXXXFSXGLGAXRTLYSAIGXDLXSHGXXVXAVEXRDRSXSXTYXFKDQSAAEIGDKSWLYLRTLKQEEETHIRNEQXRQRXKEXSQXXSLILDXDHGKPVKNALDLKFDMEQLKDSIDREKXXXXGHSFGGXTXXQTXSEDQRXRXGXXLDXWXFPLGDEXYSRXPQPXXXXNSEYFQYPANXIKXKKXYSPDKERKMXTIRGSVHQNXADXTFATGKIIGHMLKLKGDIDSNVXIDLSNKXSXXXXQKHLGLHKDXDQWDCLIEGDDENLIPGTNXNTTNQHIMLQNSSGIEKYN

SEQ ID NO: 670 - protein, 283 aa, Homo sapiens
  SITE (12)..(12): Xaa at position 12 is Ile, Ala, Val, Leu, or Gly
  SITE (14)..(14): Xaa at position 14 is Ile, Ala, Val, Leu, or Gly
  SITE (15)..(15): Xaa at position 15 is Ile, Ala, Val, Leu, or Gly
  SITE (26)..(26): Xaa at position 26 is Leu, Ala, Val, Gly, or Ile
  SITE (45)..(45): Xaa at position 45 is Leu, Ala, Val, Gly, or Ile
  SITE (55)..(55): Xaa at position 55 is Cys, Ala, Val, Gly, Ser, or Thr
  SITE (56)..(56): Xaa at position 56 is Val, Ala, Gly, Leu, or Ile
  SITE (57)..(57): Xaa at position 57 is Leu, Ala, Val, Gly, or Ile
  SITE (58)..(58): Xaa at position 58 is Leu, Ala, Val, Gly, or Ile
  SITE (76)..(76): Xaa at position 76 is Ala, Gly, or Pro
  SITE (78)..(78): Xaa at position 78 is Ile, Ala, Val, Leu, or Gly
  SITE (80)..(80): Xaa at position 80 is Ala, Gly, or Pro
  SITE (81)..(81): Xaa at position 81 is Leu, Ala, Val, Gly, or Ile
  SITE (88)..(88): Xaa at position 88 is His, Phe, Tyr, Lys, Arg, Gly, Ser Thr, Ala, Val, Leu, Ile, Asn, Met, or Gln
  SITE (89)..(89): Xaa at position 89 is Val, Ala, Gly, Leu, or Ile
  SITE (90)..(90): Xaa at position 90 is Ile, Ala, Val, Leu, or Gly
  SITE (91)..(91): Xaa at position 91 is Val, Ala, Gly, Leu, or Ile
  SITE (95)..(95): Xaa at position 95 is Cys, Ala, Val, Gly, Ser, or Thr
  SITE (98)..(98): Xaa at position 98 is Leu, Ala, Val, Gly, or Ile
  SITE (107)..(107): Xaa at position 107 is Ile, Ala, Val, Leu, or Gly
  SITE (108)..(108): Xaa at position 108 is Val, Ala, Gly, Leu, or Ile
  SITE (109)..(109): Xaa at position 109 is Ile, Ala, Val, Leu, or Gly
  SITE (110)..(110): Xaa at position 110 is Ile, Ala, Val, Leu, or Gly
  SITE (132)..(132): Xaa at position 132 is Ala, Gly, or Pro
  SITE (152)..(152): Xaa at position 152 is Leu, Ala, Val, Gly, or Ile
  SITE (156)..(156): Xaa at position 156 is Ala, Gly, or Pro
  SITE (169)..(169): Xaa at position 169 is Met, Ile, Leu, Val, Ala, or Gly
  SITE (170)..(170): Xaa at position 170 is Val, Ala, Gly, Leu, or Ile
  SITE (186)..(186): Xaa at position 186 is Phe, Tyr, Met, His, Ile, Leu, Val Ala, or Gly
  SITE (191)..(191): Xaa at position 191 is Ala, Gly, or Pro
  SITE (193)..(193): Xaa at position 193 is Val, Ala, Gly, Leu, or Ile
  SITE (199)..(199): Xaa at position 199 is Val, Ala, Gly, Leu, or Ile
  SITE (202)..(202): Xaa at position 202 is Val, Ala, Gly, Leu, or Ile
  SITE (204)..(204): Xaa at position 204 is Leu, Ala, Val, Gly, or Ile
  SITE (205)..(205): Xaa at position 205 is Ala, Gly, or Pro
  SITE (210)..(210): Xaa at position 210 is Ile, Ala, Val, Leu, or Gly
  SITE (211)..(211): Xaa at position 211 is Cys, Ala, Val, Gly, Ser, or Thr
  SITE (212)..(212): Xaa at position 212 is Tyr, Phe, Met, His, Ile, Leu, Val Ala, or Gly
  SITE (213)..(213): Xaa at position 213 is Ala, Gly, or Pro
  SITE (215)..(215): Xaa at position 215 is Ile, Ala, Val, Leu, or Gly
  SITE (216)..(216): Xaa at position 216 is Ala, Gly, or Pro
  SITE (217)..(217): Xaa at position 217 is Met, Ile, Leu, Val, Ala, or Gly
  SITE (218)..(218): Xaa at position 218 is Ala, Gly, or Pro
  SITE (250)..(250): Xaa at position 250 is Leu, Ala, Val, Gly, or Ile
  SITE (255)..(255): Xaa at position 255 is Ile, Ala, Val, Leu, or Gly
  SITE (258)..(258): Xaa at position 258 is Ile, Ala, Val, Leu, or Gly
MASGTTTTAVKXGXXGGTGLDDPEIXEGRTEKYVDTPFGKPSDAXILGKIKNVDXXXXARHGRQHTIMPSKVNYQXNXWXXKEEGCTXXXXTTAXGSXREEIQPGDXXXXDQFIDRTTMRPQSFYDGSHSCXRGVCHIPMAEPFCPKTREVXIETXKKLGLRCHSKGTXXTIEGPRFSSRAESFMXRTWGXDXINMTTXPEXVXXKEAGXXXXSXXXXTDYDCWKEHEEAVSVDRVLKTLKENANKAKSXLLTTXPQXGSTEWSETLHNLKNMAQFSVLLPRH

SEQ ID NO: 671 - protein, 1484 aa, Homo sapiens
  SITE (35)..(35): Xaa at position 35 is Ile, Ala, Val, Leu, or Gly
  SITE (37)..(37): Xaa at position 37 is Ile, Ala, Val, Leu, or Gly
  SITE (38)..(38): Xaa at position 38 is Ala, Gly, or Pro
  SITE (39)..(39): Xaa at position 39 is Val, Ala, Gly, Leu, or Ile
  SITE (40)..(40): Xaa at position 40 is Ile, Ala, Val, Leu, or Gly
  SITE (65)..(65): Xaa at position 65 is Val, Ala, Gly, Leu, or Ile
  SITE (81)..(81): Xaa at position 81 is Ile, Ala, Val, Leu, or Gly
  SITE (85)..(85): Xaa at position 85 is Ile, Ala, Val, Leu, or Gly
  SITE (97)..(97): Xaa at position 97 is Val, Ala, Gly, Leu, or Ile
  SITE (98)..(98): Xaa at position 98 is Val, Ala, Gly, Leu, or Ile
  SITE (99)..(99): Xaa at position 99 is Phe, Tyr, Met, His, Ile, Leu, Val Ala, or Gly
  SITE (100)..(100): Xaa at position 100 is Ala, Gly, or Pro
  SITE (108)..(108): Xaa at position 108 is Ile, Ala, Val, Leu, or Gly
  SITE (109)..(109): Xaa at position 109 is Ala, Gly, or Pro
  SITE (111)..(111): Xaa at position 111 is Ile, Ala, Val, Leu, or Gly
  SITE (112)..(112): Xaa at position 112 is Leu, Ala, Val, Gly, or Ile
  SITE (115)..(115): Xaa at position 115 is Ile, Ala, Val, Leu, or Gly
  SITE (117)..(117): Xaa at position 117 is Ala, Gly, or Pro
  SITE (123)..(123): Xaa at position 123 is Ile, Ala, Val, Leu, or Gly
  SITE (124)..(124): Xaa at position 124 is Leu, Ala, Val, Gly, or Ile
  SITE (126)..(126): Xaa at position 126 is Ile, Ala, Val, Leu, or Gly
  SITE (135)..(135): Xaa at position 135 is Ala, Gly, or Pro
  SITE (146)..(146): Xaa at position 146 is Phe, Tyr, Met, His, Ile, Leu, Val Ala, or Gly
  SITE (154)..(154): Xaa at position 154 is Ala, Gly, or Pro
  SITE (156)..(156): Xaa at position 156 is Val, Ala, Gly, Leu, or Ile
  SITE (157)..(157): Xaa at position 157 is Met, Ile, Leu, Val, Ala, or Gly
  SITE (160)..(160): Xaa at position 160 is Ile, Ala, Val, Leu, or Gly
  SITE (161)..(161): Xaa at position 161 is Met, Ile, Leu, Val, Ala, or Gly
  SITE (169)..(169): Xaa at position 169 is Phe, Tyr, Met, His, Ile, Leu, Val Ala, or Gly
  SITE (171)..(171): Xaa at position 171 is Ile, Ala, Val, Leu, or Gly
  SITE (172)..(172): Xaa at position 172 is Val, Ala, Gly, Leu, or Ile
  SITE (176)..(176): Xaa at position 176 is Phe, Tyr, Met, His, Ile, Leu, Val Ala, or Gly
  SITE (182)..(182): Xaa at position 182 is Phe, Tyr, Met, His, Ile, Leu, Val Ala, or Gly
  SITE (186)..(186): Xaa at position 186 is Ile, Ala, Val, Leu, or Gly
  SITE (190)..(190): Xaa at position 190 is Ile, Ala, Val, Leu, or Gly
  SITE (202)..(202): Xaa at position 202 is Val, Ala, Gly, Leu, or Ile
  SITE (205)..(205): Xaa at position 205 is Leu, Ala, Val, Gly, or Ile
  SITE (216)..(216): Xaa at position 216 is Ile, Ala, Val, Leu, or Gly
  SITE (220)..(220): Xaa at position 220 is Leu, Ala, Val, Gly, or Ile
  SITE (223)..(223): Xaa at position 223 is Leu, Ala, Val, Gly, or Ile
  SITE (228)..(228): Xaa at position 228 is Ile, Ala, Val, Leu, or Gly
  SITE (229)..(229): Xaa at position 229 is Leu, Ala, Val, Gly, or Ile
  SITE (230)..(230): Xaa at position 230 is Leu, Ala, Val, Gly, or Ile
  SITE (231)..(231): Xaa at position 231 is Tyr, Phe, Met, His, Ile, Leu, Val Ala, or Gly
  SITE (232)..(232): Xaa at position 232 is Cys, Ala, Val, Gly, Ser, or Thr
  SITE (237)..(237): Xaa at position 237 is Ala, Gly, or Pro
  SITE (240)..(240): Xaa at position 240 is Ile, Ala, Val, Leu, or Gly
  SITE (241)..(241): Xaa at position 241 is Phe, Tyr, Met, His, Ile, Leu, Val Ala, or Gly
  SITE (244)..(244): Xaa at position 244 is Ala, Gly, or Pro
  SITE (249)..(249): Xaa at position 249 is Leu, Ala, Val, Gly, or Ile
  SITE (256)..(256): Xaa at position 256 is Trp, Tyr, Phe, Met, His, Ile, Leu Val, Ala, or Gly
  SITE (257)..(257): Xaa at position 257 is Ile, Ala, Val, Leu, or Gly
  SITE (258)..(258): Xaa at position 258 is Val, Ala, Gly, Leu, or Ile
  SITE (261)..(261): Xaa at position 261 is Leu, Ala, Val, Gly, or Ile
  SITE (262)..(262): Xaa at position 262 is Val, Ala, Gly, Leu, or Ile
  SITE (263)..(263): Xaa at position 263 is Ala, Gly, or Pro
  SITE (277)..(277): Xaa at position 277 is Leu, Ala, Val, Gly, or Ile
  SITE (278)..(278): Xaa at position 278 is Ile, Ala, Val, Leu, or Gly
  SITE (280)..(280): Xaa at position 280 is Val, Ala, Gly, Leu, or Ile
  SITE (293)..(293): Xaa at position 293 is Val, Ala, Gly, Leu, or Ile
  SITE (299)..(299): Xaa at position 299 is Ile, Ala, Val, Leu, or Gly
  SITE (300)..(300): Xaa at position 300 is Ile, Ala, Val, Leu, or Gly
  SITE (303)..(303): Xaa at position 303 is Ala, Gly, or Pro
  SITE (304)..(304): Xaa at position 304 is Ala, Gly, or Pro
  SITE (307)..(307): Xaa at position 307 is Met, Ile, Leu, Val, Ala, or Gly
  SITE (308)..(308): Xaa at position 308 is Leu, Ala, Val, Gly, or Ile
  SITE (329)..(329): Xaa at position 329 is Ile, Ala, Val, Leu, or Gly
  SITE (335)..(335): Xaa at position 335 is Leu, Ala, Val, Gly, or Ile
  SITE (339)..(339): Xaa at position 339 is Leu, Ala, Val, Gly, or Ile
  SITE (342)..(342): Xaa at position 342 is Val, Ala, Gly, Leu, or Ile
  SITE (363)..(363): Xaa at position 363 is Val, Ala, Gly, Leu, or Ile
  SITE (364)..(364): Xaa at position 364 is Ile, Ala, Val, Leu, or Gly
  SITE (365)..(365): Xaa at position 365 is Ile, Ala, Val, Leu, or Gly
  SITE (367)..(367): Xaa at position 367 is Leu, Ala, Val, Gly, or Ile
  SITE (376)..(376): Xaa at position 376 is Val, Ala, Gly, Leu, or Ile
  SITE (408)..(408): Xaa at position 408 is Ile, Ala, Val, Leu, or Gly
  SITE (409)..(409): Xaa at position 409 is Val, Ala, Gly, Leu, or Ile
  SITE (416)..(416): Xaa at position 416 is Phe, Tyr, Met, His, Ile, Leu, Val Ala, or Gly
  SITE (417)..(417): Xaa at position 417 is Val, Ala, Gly, Leu, or Ile
  SITE (419)..(419): Xaa at position 419 is Val, Ala, Gly, Leu, or Ile
  SITE (436)..(436): Xaa at position 436 is Cys, Ala, Val, Gly, Ser, or Thr
  SITE (440)..(440): Xaa at position 440 is Ile, Ala, Val, Leu, or Gly
  SITE (456)..(456): Xaa at position 456 is Cys, Ala, Val, Gly, Ser, or Thr
  SITE (457)..(457): Xaa at position 457 is Cys, Ala, Val, Gly, Ser, or Thr
  SITE (460)..(460): Xaa at position 460 is Phe, Tyr, Met, His, Ile, Leu, Val Ala, or Gly
  SITE (461)..(461): Xaa at position 461 is Cys, Ala, Val, Gly, Ser, or Thr
  SITE (462)..(462): Xaa at position 462 is Ile, Ala, Val, Leu, or Gly
  SITE (464)..(464): Xaa at position 464 is Ile, Ala, Val, Leu, or Gly
  SITE (465)..(465): Xaa at position 465 is Leu, Ala, Val, Gly, or Ile
  SITE (468)..(468): Xaa at position 468 is Ile, Ala, Val, Leu, or Gly
  SITE (480)..(480): Xaa at position 480 is Leu, Ala, Val, Gly, or Ile
  SITE (494)..(494): Xaa at position 494 is Trp, Tyr, Phe, Met, His, Ile, Leu Val, Ala, or Gly
  SITE (497)..(497): Xaa at position 497 is Met, Ile, Leu, Val, Ala, or Gly
  SITE (498)..(498): Xaa at position 498 is Ile, Ala, Val, Leu, or Gly
  SITE (501)..(501): Xaa at position 501 is Val, Ala, Gly, Leu, or Ile
  SITE (506)..(506): Xaa at position 506 is Ala, Gly, or Pro
  SITE (507)..(507): Xaa at position 507 is Tyr, Phe, Met, His, Ile, Leu, Val Ala, or Gly
  SITE (508)..(508): Xaa at position 508 is Met, Ile, Leu, Val, Ala, or Gly
  SITE (509)..(509): Xaa at position 509 is Ala, Gly, or Pro
  SITE (510)..(510): Xaa at position 510 is Val, Ala, Gly, Leu, or Ile
  SITE (513)..(513): Xaa at position 513 is Leu, Ala, Val, Gly, or Ile
  SITE (523)..(523): Xaa at position 523 is Val, Ala, Gly, Leu, or Ile
  SITE (530)..(530): Xaa at position 530 is Ile, Ala, Val, Leu, or Gly
  SITE (536)..(536): Xaa at position 536 is Val, Ala, Gly, Leu, or Ile
  SITE (537)..(537): Xaa at position 537 is Met, Ile, Leu, Val, Ala, or Gly
  SITE (538)..(538): Xaa at position 538 is Val, Ala, Gly, Leu, or Ile
  SITE (663)..(663): Xaa at position 663 is Val, Ala, Gly, Leu, or Ile
  SITE (666)..(666): Xaa at position 666 is Leu, Ala, Val, Gly, or Ile
  SITE (671)..(671): Xaa at position 671 is Phe, Tyr, Met, His, Ile, Leu, Val Ala, or Gly
  SITE (683)..(683): Xaa at position 683 is Phe, Tyr, Met, His, Ile, Leu, Val Ala, or Gly
  SITE (695)..(695): Xaa at position 695 is Ile, Ala, Val, Leu, or Gly
  SITE (702)..(702): Xaa at position 702 is Met, Ile, Leu, Val, Ala, or Gly
  SITE (706)..(706): Xaa at position 706 is Met, Ile, Leu, Val, Ala, or Gly
  SITE (717)..(717): Xaa at position 717 is Ala, Gly, or Pro
  SITE (728)..(728): Xaa at position 728 is Ala, Gly, or Pro
  SITE (729)..(729): Xaa at position 729 is Phe, Tyr, Met, His, Ile, Leu, Val Ala, or Gly
  SITE (730)..(730): Xaa at position 730 is Ile, Ala, Val, Leu, or Gly
  SITE (733)..(733): Xaa at position 733 is Ala, Gly, or Pro
  SITE (734)..(734): Xaa at position 734 is Ala, Gly, or Pro
  SITE (735)..(735): Xaa at position 735 is Val, Ala, Gly, Leu, or Ile
  SITE (736)..(736): Xaa at position 736 is Leu, Ala, Val, Gly, or Ile
  SITE (762)..(762): Xaa at position 762 is Tyr, Phe, Met, His, Ile, Leu, Val Ala, or Gly
  SITE (764)..(764): Xaa at position 764 is Ile, Ala, Val, Leu, or Gly
  SITE (765)..(765): Xaa at position 765 is Ala, Gly, or Pro
  SITE (766)..(766): Xaa at position 766 is Ile, Ala, Val, Leu, or Gly
  SITE (776)..(776): Xaa at position 776 is Val, Ala, Gly, Leu, or Ile
  SITE (779)..(779): Xaa at position 779 is Ala, Gly, or Pro
  SITE (780)..(780): Xaa at position 780 is Ile, Ala, Val, Leu, or Gly
  SITE (783)..(783): Xaa at position 783 is Leu, Ala, Val, Gly, or Ile
  SITE (789)..(789): Xaa at position 789 is Met, Ile, Leu, Val, Ala, or Gly
  SITE (792)..(792): Xaa at position 792 is Leu, Ala, Val, Gly, or Ile
  SITE (808)..(808): Xaa at position 808 is Val, Ala, Gly, Leu, or Ile
MKPRAECCSPKFWLVLAVLAVSGSRARSQKSPPSXGXXXXLVGTSDEVAIKDAHEKDDFHHLSVXPRVELVAMNETDPKSXITRXCDLMSDRKIQGXXXXDDTDQEAXXQXXDFXSXQTLTPXXGXHGGSSMIMXDKDESSMFFQXGPSIEQQXSXXLNXXEEYDWYIXSXXTTYXPGYQDXVNKXRSTXENSFVGWELEEXLLXDMSLDDGDSKXQNQXKKXQSPIXXXXXTKEEXTYXXEVXNSVGXTGYGYTXXXPSXXXGDTDTVPAEFPTGXXSXSYDEWDYGLPARXRDGIAXXTTXXSDXXSEHSFIPEPKSSCYNTHEKRXYQSNMXNRYXINXTFEGRNLSFSEDGYQMHPKLXXXLXNKERKWERXGKWKDKSLQMKYYVWPRMCPETEEQEDDHLSXXTLEEAPXXIXESVDPLSGTCMRNTVPXQKRXVTENKTDEEPGYIKKXXKGXXXDXXKKXSKSVKFTYDLYXVTNGKHGKKINGTXNGXXGEXVMKRXXXXXGSXTINEERSEVXDFSVPFXETGISXXXSRSNGTVSPSAFLEPFSADVWVMMFVMLLIVSAVAVFVFEYFSPVGYNRCLADGREPGGPSFTIGKAIWLLWGLVFNNSVPVQNPKGTTSKIMVSVWAFFAVIFLASYTANLAAFMIQEEYVDQXSGXSDKKXQRPNDFSPPFRXGTVPNGSTERNXRNNYAEXHAYXGKFNQRGVDDXLLSLKTGKLDXXXYDXXXXNYMAGRDEGCKLVTIGSGKVFASTGXGXXXQKDSGWKRQXDLXXLQXFGDGEXEEXEALWLTGICHNEKNEXMSSQLDIDNMAGVFYMLGAAMALSLITFICEHLFYWQFRHCFMGVCSGKPGMVFSISRGIYSCIHGVAIEERQSVMNSPTATMNNTHSNILRLLRTAKNMANLSGVNGSPQSALDFIRRESSVYDISEHRRSFTHSDCKSYNNPPCEENLFSDYISEVERTFGNLQLKDSNVYQDHYHHHHRPHSIGSASSIDGLYDCDNPPFTTQSRSISKKPLDIGLPSSKHSQLSDLYGKFSFKSDRYSGHDDLIRSDVSDISTHTVTYGNIEGNAAKRRKQQYKDSLKKRPASAKSRREFDEIELAYRRRPPRSPDHKRYFRDKEGLRDFYLDQFRTKENSPHWEHVDLTDIYKERSDDFKRDSVSGGGPCTNRSHIKHGTGDKHGVVSGVPAPWEKNLTNVEWEDRSGGNFCRSCPSKLHNYSTTVTGQNSGRQACIRCEACKKAGNLYDISEDNSLQELDQPAAPVAVTSNASTTKYPQSPTNSKAQKKNRNKLRRQHSYDTFVDLQKEEAALAPRSVSLKDKGRFMDGSPYAHMFEMSAGESTFANNKSSVPTAGHHHHNNPGGGYMLSKSLYPDRVTQNPFIPTFGDDQCLLHGSKSYFFRQPTVAGASKARPDFRALVTNKPVVSALHGAVPARFQKDICIGNQSNPCVPNNKNPRAFNGSSNGHVYEKLSSIESDV

SEQ ID NO: 672 - protein, 466 aa, Homo sapiens
  SITE (24)..(24): Xaa at position 24 is Leu, Ala, Val, Gly, or Ile
  SITE (25)..(25): Xaa at position 25 is Val, Ala, Gly, Leu, or Ile
  SITE (26)..(26): Xaa at position 26 is Cys, Ala, Val, Gly, Ser, or Thr
  SITE (27)..(27): Xaa at position 27 is Tyr, Phe, Met, His, Ile, Leu, Val Ala, or Gly
  SITE (28)..(28): Xaa at position 28 is Phe, Tyr, Met, His, Ile, Leu, Val Ala, or Gly
  SITE (32)..(32): Xaa at position 32 is Ala, Gly, or Pro
  SITE (39)..(39): Xaa at position 39 is Ala, Gly, or Pro
  SITE (41)..(41): Xaa at position 41 is Phe, Tyr, Met, His, Ile, Leu, Val Ala, or Gly
  SITE (46)..(46): Xaa at position 46 is Leu, Ala, Val, Gly, or Ile
  SITE (50)..(50): Xaa at position 50 is Leu, Ala, Val, Gly, or Ile
  SITE (51)..(51): Xaa at position 51 is Cys, Ala, Val, Gly, Ser, or Thr
  SITE (54)..(54): Xaa at position 54 is Leu, Ala, Val, Gly, or Ile
  SITE (55)..(55): Xaa at position 55 is Ile, Ala, Val, Leu, or Gly
  SITE (56)..(56): Xaa at position 56 is Tyr, Phe, Met, His, Ile, Leu, Val Ala, or Gly
  SITE (57)..(57): Xaa at position 57 is Ala, Gly, or Pro
  SITE (58)..(58): Xaa at position 58 is Phe, Tyr, Met, His, Ile, Leu, Val Ala, or Gly
  SITE (59)..(59): Xaa at position 59 is Ala, Gly, or Pro
  SITE (61)..(61): Xaa at position 61 is Met, Ile, Leu, Val, Ala, or Gly
  SITE (77)..(77): Xaa at position 77 is Tyr, Phe, Met, His, Ile, Leu, Val Ala, or Gly
  SITE (80)..(80): Xaa at position 80 is Phe, Tyr, Met, His, Ile, Leu, Val Ala, or Gly
  SITE (90)..(90): Xaa at position 90 is Leu, Ala, Val, Gly, or Ile
  SITE (93)..(93): Xaa at position 93 is Leu, Ala, Val, Gly, or Ile
  SITE (94)..(94): Xaa at position 94 is Leu, Ala, Val, Gly, or Ile
  SITE (95)..(95): Xaa at position 95 is Ala, Gly, or Pro
  SITE (96)..(96): Xaa at position 96 is Ile, Ala, Val, Leu, or Gly
  SITE (101)..(101): Xaa at position 101 is Phe, Tyr, Met, His, Ile, Leu, Val Ala, or Gly
  SITE (106)..(106): Xaa at position 106 is Phe, Tyr, Met, His, Ile, Leu, Val Ala, or Gly
  SITE (109)..(109): Xaa at position 109 is Met, Ile, Leu, Val, Ala, or Gly
  SITE (110)..(110): Xaa at position 110 is Val, Ala, Gly, Leu, or Ile
  SITE (119)..(119): Xaa at position 119 is Phe, Tyr, Met, His, Ile, Leu, Val Ala, or Gly
  SITE (120)..(120): Xaa at position 120 is Val, Ala, Gly, Leu, or Ile
  SITE (123)..(123): Xaa at position 123 is Ala, Gly, or Pro
  SITE (127)..(127): Xaa at position 127 is Leu, Ala, Val, Gly, or Ile
  SITE (132)..(132): Xaa at position 132 is Phe, Tyr, Met, His, Ile, Leu, Val Ala, or Gly
  SITE (135)..(135): Xaa at position 135 is Leu, Ala, Val, Gly, or Ile
  SITE (137)..(137): Xaa at position 137 is Leu, Ala, Val, Gly, or Ile
  SITE (139)..(139): Xaa at position 139 is Trp, Tyr, Phe, Met, His, Ile, Leu Val, Ala, or Gly
  SITE (155)..(155): Xaa at position 155 is Phe, Tyr, Met, His, Ile, Leu, Val Ala, or Gly
  SITE (158)..(158): Xaa at position 158 is Leu, Ala, Val, Gly, or Ile
  SITE (159)..(159): Xaa at position 159 is Val, Ala, Gly, Leu, or Ile
  SITE (162)..(162): Xaa at position 162 is Leu, Ala, Val, Gly, or Ile
  SITE (166)..(166): Xaa at position 166 is Phe, Tyr, Met, His, Ile, Leu, Val Ala, or Gly
  SITE (178)..(178): Xaa at position 178 is Leu, Ala, Val, Gly, or Ile
  SITE (179)..(179): Xaa at position 179 is Leu, Ala, Val, Gly, or Ile
  SITE (180)..(180): Xaa at position 180 is Leu, Ala, Val, Gly, or Ile
  SITE (182)..(182): Xaa at position 182 is Ala, Gly, or Pro
  SITE (183)..(183): Xaa at position 183 is Ala, Gly, or Pro
  SITE (184)..(184): Xaa at position 184 is Val, Ala, Gly, Leu, or Ile
  SITE (186)..(186): Xaa at position 186 is Ala, Gly, or Pro
  SITE (191)..(191): Xaa at position 191 is Val, Ala, Gly, Leu, or Ile
  SITE (197)..(197): Xaa at position 197 is Val, Ala, Gly, Leu, or Ile
  SITE (200)..(200): Xaa at position 200 is Ile, Ala, Val, Leu, or Gly
  SITE (201)..(201): Xaa at position 201 is Ala, Gly, or Pro
  SITE (204)..(204): Xaa at position 204 is Leu, Ala, Val, Gly, or Ile
  SITE (206)..(206): Xaa at position 206 is Phe, Tyr, Met, His, Ile, Leu, Val Ala, or Gly
  SITE (207)..(207): Xaa at position 207 is Val, Ala, Gly, Leu, or Ile
  SITE (209)..(209): Xaa at position 209 is Leu, Ala, Val, Gly, or Ile
  SITE (211)..(211): Xaa at position 211 is Ala, Gly, or Pro
  SITE (224)..(224): Xaa at position 224 is His, Phe, Tyr, Lys, Arg, Gly, Ser Thr, Ala, Val, Leu, Ile, Asn, Met, or Gln
  SITE (228)..(228): Xaa at position 228 is Leu, Ala, Val, Gly, or Ile
  SITE (243)..(243): Xaa at position 243 is Val, Ala, Gly, Leu, or Ile
  SITE (246)..(246): Xaa at position 246 is Ala, Gly, or Pro
  SITE (247)..(247): Xaa at position 247 is Val, Ala, Gly, Leu, or Ile
  SITE (250)..(250): Xaa at position 250 is Trp, Tyr, Phe, Met, His, Ile, Leu Val, Ala, or Gly
  SITE (260)..(260): Xaa at position 260 is Leu, Ala, Val, Gly, or Ile
  SITE (261)..(261): Xaa at position 261 is Ile, Ala, Val, Leu, or Gly
  SITE (262)..(262): Xaa at position 262 is Leu, Ala, Val, Gly, or Ile
  SITE (264)..(264): Xaa at position 264 is Met, Ile, Leu, Val, Ala, or Gly
  SITE (271)..(271): Xaa at position 271 is Phe, Tyr, Met, His, Ile, Leu, Val Ala, or Gly
  SITE (281)..(281): Xaa at position 281 is Val, Ala, Gly, Leu, or Ile
  SITE (283)..(283): Xaa at position 283 is Ala, Gly, or Pro
  SITE (302)..(302): Xaa at position 302 is Ala, Gly, or Pro
  SITE (304)..(304): Xaa at position 304 is Tyr, Phe, Met, His, Ile, Leu, Val Ala, or Gly
  SITE (306)..(306): Xaa at position 306 is Val, Ala, Gly, Leu, or Ile
  SITE (322)..(322): Xaa at position 322 is Val, Ala, Gly, Leu, or Ile
  SITE (324)..(324): Xaa at position 324 is Tyr, Phe, Met, His, Ile, Leu, Val Ala, or Gly
  SITE (325)..(325): Xaa at position 325 is Ile, Ala, Val, Leu, or Gly
  SITE (331)..(331): Xaa at position 331 is Trp, Tyr, Phe, Met, His, Ile, Leu Val, Ala, or Gly
  SITE (332)..(332): Xaa at position 332 is Val, Ala, Gly, Leu, or Ile
  SITE (334)..(334): Xaa at position 334 is Phe, Tyr, Met, His, Ile, Leu, Val Ala, or Gly
  SITE (340)..(340): Xaa at position 340 is Phe, Tyr, Met, His, Ile, Leu, Val Ala, or Gly
  SITE (344)..(344): Xaa at position 344 is Val, Ala, Gly, Leu, or Ile
  SITE (347)..(347): Xaa at position 347 is Leu, Ala, Val, Gly, or Ile
  SITE (355)..(355): Xaa at position 355 is Ala, Gly, or Pro
  SITE (356)..(356): Xaa at position 356 is Met, Ile, Leu, Val, Ala, or Gly
  SITE (357)..(357): Xaa at position 357 is Val, Ala, Gly, Leu, or Ile
  SITE (359)..(359): Xaa at position 359 is Ala, Gly, or Pro
  SITE (360)..(360): Xaa at position 360 is Leu, Ala, Val, Gly, or Ile
  SITE (365)..(365): Xaa at position 365 is Phe, Tyr, Met, His, Ile, Leu, Val Ala, or Gly
  SITE (375)..(375): Xaa at position 375 is Tyr, Phe, Met, His, Ile, Leu, Val Ala, or Gly
  SITE (377)..(377): Xaa at position 377 is Leu, Ala, Val, Gly, or Ile
  SITE (378)..(378): Xaa at position 378 is Ile, Ala, Val, Leu, or Gly
  SITE (381)..(381): Xaa at position 381 is Leu, Ala, Val, Gly, or Ile
  SITE (420)..(420): Xaa at position 420 is Cys, Ala, Val, Gly, Ser, or Thr
MVRSVAWAGFMVLLMIPWGSAAKXXXXXTNWXQYRQGEXRXLPKDXDPSXXTHXXXXXXGXTNHQLSTTEWNDETLXQEXNGLKKMNPKXKTXXXXGGWNXGTQKXTDXXATANNRQTXXNSXIRFXRKYSXDGXDXDXEYPGSQGSPAVDKERXTTXXQDXANAXQQEAQTSGKERXXXSXXXPXGQTYXDAGYEXDKXXQNXDXXNXMXYDFHGSWEKVTGXNSPXYKRQEESGAAASLNXDAXXQQXLQKGTPASKXXXGXPTYGRSXTLASSSDTRXGXPATGSGTPGPFTKEGGMLXYXEXCSWKGATKQRIQDQKXPXXFRDNQXXGXDDVESXKTKXSYXKQKGLGGXXXWXXDLDDXAGFSCNQGRXPXXQTXRQELSLPYLPSGTPELEVPKPGQPSEPEHGPSPGQDTFXQGKADGLYPNPRERSSFYSCAAGRLFQQSCPTGLVFSNSCKCCTWN

SEQ ID NO: 673 - protein, 232 aa, Homo sapiens
  SITE (66)..(66): Xaa at position 66 is Leu, Ala, Val, Gly, or Ile
  SITE (173)..(173): Xaa at position 173 is Val, Ala, Gly, Leu, or Ile
  SITE (184)..(184): Xaa at position 184 is Cys, Ala, Val, Gly, Ser, or Thr
  SITE (202)..(202): Xaa at position 202 is Val, Ala, Gly, Leu, or Ile
  SITE (203)..(203): Xaa at position 203 is Leu, Ala, Val, Gly, or Ile
MERCPSLGVTLYALVVVLGLRATPAGGQHYLHIRPAPSDNLPLVDLIEHPDPIFDPKEKDLNETLXRSLLGGHYDPGFMATSPPEDRPGGGGGAAGGAEDLAELDQLLRQRPSGAMPSEIKGLEFSEGLAQGKKQRLSKKLRRKLQMWLWSQTFCPVLYAWNDLGSRFWPRYXKVGSCFSKRSXSVPEGMVCKPSKSVHLTXXRWRCQRRGGQRCGWIPIQYPIISECKCSC

SEQ ID NO: 674 - protein, 526 aa, Homo sapiens
  SITE (40)..(40): Xaa at position 40 is Ala, Gly, or Pro
  SITE (46)..(46): Xaa at position 46 is Ala, Gly, or Pro
  SITE (48)..(48): Xaa at position 48 is Leu, Ala, Val, Gly, or Ile
  SITE (50)..(50): Xaa at position 50 is Cys, Ala, Val, Gly, Ser, or Thr
  SITE (58)..(58): Xaa at position 58 is Ala, Gly, or Pro
  SITE (63)..(63): Xaa at position 63 is Leu, Ala, Val, Gly, or Ile
  SITE (65)..(65): Xaa at position 65 is Trp, Tyr, Phe, Met, His, Ile, Leu Val, Ala, or Gly
  SITE (73)..(73): Xaa at position 73 is Ala, Gly, or Pro
  SITE (74)..(74): Xaa at position 74 is Val, Ala, Gly, Leu, or Ile
  SITE (91)..(91): Xaa at position 91 is Tyr, Phe, Met, His, Ile, Leu, Val Ala, or Gly
  SITE (109)..(109): Xaa at position 109 is Leu, Ala, Val, Gly, or Ile
  SITE (111)..(111): Xaa at position 111 is Ile, Ala, Val, Leu, or Gly
  SITE (114)..(114): Xaa at position 114 is Val, Ala, Gly, Leu, or Ile
  SITE (122)..(122): Xaa at position 122 is Tyr, Phe, Met, His, Ile, Leu, Val Ala, or Gly
  SITE (124)..(124): Xaa at position 124 is Cys, Ala, Val, Gly, Ser, or Thr
  SITE (126)..(126): Xaa at position 126 is Phe, Tyr, Met, His, Ile, Leu, Val Ala, or Gly
  SITE (136)..(136): Xaa at position 136 is Leu, Ala, Val, Gly, or Ile
  SITE (137)..(137): Xaa at position 137 is Val, Ala, Gly, Leu, or Ile
  SITE (139)..(139): Xaa at position 139 is Leu, Ala, Val, Gly, or Ile
  SITE (208)..(208): Xaa at position 208 is Ile, Ala, Val, Leu, or Gly
  SITE (364)..(364): Xaa at position 364 is Val, Ala, Gly, Leu, or Ile
  SITE (379)..(379): Xaa at position 379 is Val, Ala, Gly, Leu, or Ile
  SITE (452)..(452): Xaa at position 452 is Phe, Tyr, Met, His, Ile, Leu, Val Ala, or Gly
  SITE (460)..(460): Xaa at position 460 is Phe, Tyr, Met, His, Ile, Leu, Val Ala, or Gly
MAVFPSSGLPRCLLTLILLQLPKLDSAPFDVIGPPEPILXVVGEDXEXPXRLSPNASXEHLEXRXFRKKVSPXXLVHRDGREQEAEQMPEXRGRATLVQDGIAKGRVAXRXRGXRVSDDGEXTXFXREDGSYEEAXXHXKVAALGSDPHISMQVQENGEICLECTSVGWYPEPQVQWRTSKGEKFPSTSESRNPDEEGLFTVAASVIXRDTSAKNVSCYIQNLLLGQEKKVEISIPASSLPRLTPWIVAVAVILMVLGLLTIGSIFFTWRLYNERPRERRNEFSSKERLLEELKWKKATLHAVDVTLDPDTAHPHLFLYEDSKSVRLEDSRQKLPEKTERFDSWPCVLGRETFTSGRHYWEVEXGDRTDWAIGVCRENXMKKGFDPMTPENGFWAVELYGNGYWALTPLRTPLPLAGPPRRVGIFLDYESGDISFYNMNDGSDIYTFSNVTXSGPLRPFXCLWSSGKKPLTICPIADGPERVTVIANAQDLSKEIPLSPMGEDSAPRDADTLHSKLIPTQPSQGAP

SEQ ID NO: 675 - protein, 630 aa, Homo sapiens
  SITE (311)..(311): Xaa at position 311 is Ile, Ala, Val, Leu, or Gly
  SITE (315)..(315): Xaa at position 315 is Leu, Ala, Val, Gly, or Ile
  SITE (316)..(316): Xaa at position 316 is Ile, Ala, Val, Leu, or Gly
  SITE (323)..(323): Xaa at position 323 is Leu, Ala, Val, Gly, or Ile
  SITE (326)..(326): Xaa at position 326 is Cys, Ala, Val, Gly, Ser, or Thr
  SITE (327)..(327): Xaa at position 327 is Val, Ala, Gly, Leu, or Ile
  SITE (332)..(332): Xaa at position 332 is Leu, Ala, Val, Gly, or Ile
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREXDESXXFYKKWEXEAXXDAALXATQMDRVNAIPFTYEQLDVLKHKLDELYPQGYPESVIQHLGYLFLKMSPEDIRKWNVTSLETLKALLEVNKGHEMSPQAPRRPLPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALSGTPCLLGPGPVLTVLALLLASTLA

SEQ ID NO: 676 - protein, 505 aa, Homo sapiens
  SITE (13)..(13): Xaa at position 13 is Leu, Ala, Val, Gly, or Ile
  SITE (31)..(31): Xaa at position 31 is Val, Ala, Gly, Leu, or Ile
  SITE (33)..(33): Xaa at position 33 is Leu, Ala, Val, Gly, or Ile
  SITE (40)..(40): Xaa at position 40 is Leu, Ala, Val, Gly, or Ile
  SITE (42)..(42): Xaa at position 42 is Val, Ala, Gly, Leu, or Ile
  SITE (88)..(88): Xaa at position 88 is Val, Ala, Gly, Leu, or Ile
  SITE (90)..(90): Xaa at position 90 is Val, Ala, Gly, Leu, or Ile
  SITE (112)..(112): Xaa at position 112 is Ile, Ala, Val, Leu, or Gly
  SITE (114)..(114): Xaa at position 114 is Ile, Ala, Val, Leu, or Gly
  SITE (122)..(122): Xaa at position 122 is Ala, Gly, or Pro
  SITE (123)..(123): Xaa at position 123 is Ala, Gly, or Pro
  SITE (129)..(129): Xaa at position 129 is Leu, Ala, Val, Gly, or Ile
  SITE (134)..(134): Xaa at position 134 is Ala, Gly, or Pro
  SITE (135)..(135): Xaa at position 135 is Ile, Ala, Val, Leu, or Gly
  SITE (138)..(138): Xaa at position 138 is Val, Ala, Gly, Leu, or Ile
  SITE (143)..(143): Xaa at position 143 is Leu, Ala, Val, Gly, or Ile
  SITE (151)..(151): Xaa at position 151 is Ala, Gly, or Pro
  SITE (162)..(162): Xaa at position 162 is Val, Ala, Gly, Leu, or Ile
  SITE (163)..(163): Xaa at position 163 is Val, Ala, Gly, Leu, or Ile
  SITE (164)..(164): Xaa at position 164 is Leu, Ala, Val, Gly, or Ile
  SITE (166)..(166): Xaa at position 166 is Val, Ala, Gly, Leu, or Ile
  SITE (215)..(215): Xaa at position 215 is Met, Ile, Leu, Val, Ala, or Gly
  SITE (236)..(236): Xaa at position 236 is Leu, Ala, Val, Gly, or Ile
  SITE (238)..(238): Xaa at position 238 is Ile, Ala, Val, Leu, or Gly
  SITE (241)..(241): Xaa at position 241 is Ala, Gly, or Pro
  SITE (247)..(247): Xaa at position 247 is Leu, Ala, Val, Gly, or Ile
  SITE (249)..(249): Xaa at position 249 is Leu, Ala, Val, Gly, or Ile
  SITE (251)..(251): Xaa at position 251 is Ala, Gly, or Pro
  SITE (257)..(257): Xaa at position 257 is Ala, Gly, or Pro
  SITE (264)..(264): Xaa at position 264 is Ile, Ala, Val, Leu, or Gly
MASGRRAPRTGLXELRAGAGSGAGGERWQRXLXSLAEDVXTXSPADGDPGPEPGAPREQEPAQLNGAAEPGAGPPQLPEALLLQRRRXTXRKADAGGLGISIKGGRENKMPXLXSKIFKGLXXDQTEAXFVGDXXLSXNGEDXSSATHDEXVQVLKKTGKEXXXEXKYMKDVSPYFKNSTGGTSVGWDSPPASPLQRQPSSPGPTPRNFSEAKHXSLKMAYVSKRCTPNDPEPRYXEXCSXDGQDTXFXRXKDEASXRSWATAXQAQVNTLTPRVKDELQALLAATSTAGSQDIKQIGWLTEQLPSGGTAPTLALLTEKELLLYLSLPETREALSRPARTAPLIATRLVHSGPSKGSVPYDAELSFALRTGTRHGVDTHLFSVESPQELAAWTRQLVDGCHRAAEGVQEVSTACTWNGRPCSLSVHIDKGFTLWAAEPGAARAVLLRQPFEKLQMSSDDGASLLFLDFGGAEGEIQLDLHSCPKTIVFIIHSFLSAKVTRLGLLA

SEQ ID NO: 677 - protein, 541 aa, Homo sapiens
  SITE (28)..(28): Xaa at position 28 is Ile, Ala, Val, Leu, or Gly
  SITE (31)..(31): Xaa at position 31 is Val, Ala, Gly, Leu, or Ile
  SITE (38)..(38): Xaa at position 38 is Leu, Ala, Val, Gly, or Ile
  SITE (40)..(40): Xaa at position 40 is His, Phe, Tyr, Lys, Arg, Gly, Ser Thr, Ala, Val, Leu, Ile, Asn, Met, or Gln
  SITE (56)..(56): Xaa at position 56 is Trp, Tyr, Phe, Met, His, Ile, Leu Val, Ala, or Gly
  SITE (82)..(82): Xaa at position 82 is Val, Ala, Gly, Leu, or Ile
  SITE (83)..(83): Xaa at position 83 is Leu, Ala, Val, Gly, or Ile
  SITE (85)..(85): Xaa at position 85 is Phe, Tyr, Met, His, Ile, Leu, Val Ala, or Gly
  SITE (88)..(88): Xaa at position 88 is Val, Ala, Gly, Leu, or Ile
  SITE (96)..(96): Xaa at position 96 is Tyr, Phe, Met, His, Ile, Leu, Val Ala, or Gly
  SITE (98)..(98): Xaa at position 98 is Phe, Tyr, Met, His, Ile, Leu, Val Ala, or Gly
  SITE (107)..(107): Xaa at position 107 is Trp, Tyr, Phe, Met, His, Ile, Leu Val, Ala, or Gly
  SITE (109)..(109): Xaa at position 109 is Leu, Ala, Val, Gly, or Ile
  SITE (136)..(136): Xaa at position 136 is Phe, Tyr, Met, His, Ile, Leu, Val Ala, or Gly
  SITE (140)..(140): Xaa at position 140 is Cys, Ala, Val, Gly, Ser, or Thr
  SITE (154)..(154): Xaa at position 154 is Leu, Ala, Val, Gly, or Ile
  SITE (175)..(175): Xaa at position 175 is Ala, Gly, or Pro
  SITE (185)..(185): Xaa at position 185 is Cys, Ala, Val, Gly, Ser, or Thr
  SITE (187)..(187): Xaa at position 187 is His, Phe, Tyr, Lys, Arg, Gly, Ser Thr, Ala, Val, Leu, Ile, Asn, Met, or Gln
  SITE (189)..(189): Xaa at position 189 is Leu, Ala, Val, Gly, or Ile
  SITE (237)..(237): Xaa at position 237 is Cys, Ala, Val, Gly, Ser, or Thr
  SITE (239)..(239): Xaa at position 239 is Ala, Gly, or Pro
  SITE (241)..(241): Xaa at position 241 is Leu, Ala, Val, Gly, or Ile
  SITE (278)..(278): Xaa at position 278 is Ala, Gly, or Pro
  SITE (282)..(282): Xaa at position 282 is Leu, Ala, Val, Gly, or Ile
  SITE (284)..(284): Xaa at position 284 is Ile, Ala, Val, Leu, or Gly
  SITE (298)..(298): Xaa at position 298 is Cys, Ala, Val, Gly, Ser, or Thr
  SITE (300)..(300): Xaa at position 300 is Val, Ala, Gly, Leu, or Ile
  SITE (313)..(313): Xaa at position 313 is Leu, Ala, Val, Gly, or Ile
MNCRELPLTLWVLISVSTAESCTSRPHXTVXEGEPFYXKXCSCSLAHEIETTTKSXYKSSGSQEHVELNPRSSSRIALHDCXXEXWPXELNDTGSXFXQMKNYTQKXKXNVIRRNKHSCFTERQVTSKIVEVKKFXQITXENSYYQTLVNSTSXYKNCKKLLLENNKNPTIKKNXEFEDQGYYSXVXFXHHNGKLFNITKTFNITIVEDRSNIVPVLLGPKLNHVAVELGKNVRLNXSXLXNEEDVIYWMFGEENGSDPNIHEEKEMRIMTPEGKWHXSKVXRXENIGESNLNVLYNXTXASTGGTDTKSFIXVRKADMADIPGHVFTRGMIIAVLILVAVVCLVTVCVIYRVDLVLFYRHLTRRDETLTDGKTYDAFVSYLKECRPENGEEHTFAVEILPRVLEKHFGYKLCIFERDVVPGGAVVDEIHSLIEKSRRLIIVLSKSYMSNEVRYELESGLHEALVERKIKIILIEFTPVTDFTFLPQSLKLLKSHRVLKWKADKSLSYNSRFWKNLLYLMPAKTVKPGRDEPEVLPVLSES

SEQ ID NO: 678 - protein, 603 aa, Homo sapiens
  SITE (185)..(185): Xaa at position 185 is Ile, Ala, Val, Leu, or Gly
  SITE (321)..(321): Xaa at position 321 is Leu, Ala, Val, Gly, or Ile
  SITE (329)..(329): Xaa at position 329 is Tyr, Phe, Met, His, Ile, Leu, Val Ala, or Gly
  SITE (350)..(350): Xaa at position 350 is Ile, Ala, Val, Leu, or Gly
  SITE (385)..(385): Xaa at position 385 is Leu, Ala, Val, Gly, or Ile
  SITE (388)..(388): Xaa at position 388 is Leu, Ala, Val, Gly, or Ile
  SITE (393)..(393): Xaa at position 393 is Leu, Ala, Val, Gly, or Ile
  SITE (438)..(438): Xaa at position 438 is Phe, Tyr, Met, His, Ile, Leu, Val Ala, or Gly
  SITE (455)..(455): Xaa at position 455 is Ala, Gly, or Pro
  SITE (475)..(475): Xaa at position 475 is Phe, Tyr, Met, His, Ile, Leu, Val Ala, or Gly
  SITE (479)..(479): Xaa at position 479 is Leu, Ala, Val, Gly, or Ile
  SITE (539)..(539): Xaa at position 539 is Ile, Ala, Val, Leu, or Gly
MASASTSKYNSHSLENESIKRTSRDGVNRDLTEAVPRLPGETLITDKEVIYICPFNGPIKGRVYITNYRLYLRSLETDSSLILDVPLGVISRIEKMGGATSRGENSYGLDITCKDMRNLRFALKQEGHSRRDMFEILTRYAFPLAHSLPLFAFLNEEKFNVDGWTVYNPVEEYRRQGLPNHHWRXTFINKCYELCDTYPALLVVPYRASDDDLRRVATFRSRNRIPVLSWIHPENKTVIVRCSQPLVGMSGKRNKDDEKYLDVIRETNKQISKLTIYDARPSVNAVANKATGGGYESDDAYHNAELFFLDIHNIHVMRESXKKVKDIVXPNVEESHWLSSLESTHWLEHXKLVLTGAIQVADKVSSGKSSVLVHCSDGWDRTAQXTSXAMLMXDSFYRSIEGFEILVQKEWISFGHKFASRIGHGDKNHTDADRSPIXLQFIDCVWQMSKQFPTXFEFNEQFLIIILDHLYSCRXGTFXFNCESARERQKVTERTVSLWSLINSNKEKFKNPFYTKEINRVLYPVASMRHLELWVNYYXRWNPRIKQQQPNPVEQRYMELLALRDEYIKRLEELQLANSAKLSDPPTSPSSPSQMMPHVQTHF

SEQ ID NO: 679 - protein, 440 aa, Homo sapiens
  SITE (8)..(8): Xaa at position 8 is Ala, Gly, or Pro
  SITE (10)..(10): Xaa at position 10 is Leu, Ala, Val, Gly, or Ile
  SITE (47)..(47): Xaa at position 47 is Leu, Ala, Val, Gly, or Ile
  SITE (51)..(51): Xaa at position 51 is Val, Ala, Gly, Leu, or Ile
  SITE (55)..(55): Xaa at position 55 is Phe, Tyr, Met, His, Ile, Leu, Val Ala, or Gly
  SITE (65)..(65): Xaa at position 65 is Ala, Gly, or Pro
  SITE (77)..(77): Xaa at position 77 is Phe, Tyr, Met, His, Ile, Leu, Val Ala, or Gly
  SITE (86)..(86): Xaa at position 86 is Ala, Gly, or Pro
  SITE (97)..(97): Xaa at position 97 is Ile, Ala, Val, Leu, or Gly
  SITE (99)..(99): Xaa at position 99 is Ile, Ala, Val, Leu, or Gly
  SITE (394)..(394): Xaa at position 394 is Leu, Ala, Val, Gly, or Ile
  SITE (401)..(401): Xaa at position 401 is Met, Ile, Leu, Val, Ala, or Gly
  SITE (413)..(413): Xaa at position 413 is Leu, Ala, Val, Gly, or Ile
  SITE (417)..(417): Xaa at position 417 is Leu, Ala, Val, Gly, or Ile
  SITE (427)..(427): Xaa at position 427 is Ala, Gly, or Pro
  SITE (431)..(431): Xaa at position 431 is Ile, Ala, Val, Leu, or Gly
MASLTVKXYXLGKEDAAREIRRFSFCCSPEPEAEAEAAAGPGPCERXLSRXAALXPALRPGGFQXHYRDEDGDLVAXSSDEELTMXMSYVKDDIFRXYXKEKKECRRDHRPPCAQEAPRNMVHPNVICDGCNGPVVGTRYKCSVCPDYDLCSVCEGKGLHRGHTKLAFPSPFGHLSEGFSHSRWLRKVKHGHFGWPGWEMGPPGNWSPRPPRAGEARPGPTAESASGPSEDPSVNFLKNVGESVAAALSPLGIEVDIDVEHGGKRSRLTPVSPESSSTEEKSSSQPSSCCSDPSKPGGNVEGATQSLAEQMRKIALESEGRPEEQMESDNCSGGDDDWTHLSSKEVDPSTGELQSLQMPESEGPSSLDPSQEGPTGLKEAALYPHLPPEADPRXIESLSQXLSMGFSDEGGWXTRLXQTKNYDIGAXLDTXQYSKHPPPL

SEQ ID NO: 680 - protein, 968 aa, Homo sapiens
  SITE (736)..(736): Xaa at position 736 is Leu, Ala, Val, Gly, or Ile
  SITE (745)..(745): Xaa at position 745 is Leu, Ala, Val, Gly, or Ile
  SITE (770)..(770): Xaa at position 770 is Leu, Ala, Val, Gly, or Ile
MVNSSRVQPQQPGDAKRPPAPRAPDPGRLMAGCAAVGASLAAPGGLCEQRGLEIEMQRIRQAAARDPPAGAAASPSPPLSSCSRQAWSRDNPGFEAEEEEEEVEGEEGGMVVEMDVEWRPGSRRSAASSAVSSVGARSRGLGGYHGAGHPSGRRRRREDQGPPCPSPVGGGDPLHRHLPLEGQPPRVAWAERLVRGLRGLWGTRLMEESSTNREKYLKSVLRELVTYLLFLIVLCILTYGMMSSNVYYYTRMMSQLFLDTPVSKTEKTNFKTLSSMEDFWKFTEGSLLDGLYWKMQPSNQTEADNRSFIFYENLLLGVPRIRQLRVRNGSCSIPQDLRDEIKECYDVYSVSSEDRAPFGPRNGTAWIYTSEKDLNGSSHWGIIATYSGAGYYLDLSRTREETAAQVASLKKNVWLDRGTRATFIDFSVYNANINLFCVVRLLVEFPATGGVIPSWQFQPLKLIRYVTTFDFFLAACEIIFCFFIFYYVVEEILEIRIHKLHYFRSFWNCLDVVIVVLSVVAIGINIYRTSNVEVLLQFLEDQNTFPNFEHLAYWQIQFNNIAAVTVFFVWIKLFKFINFNRTMSQLSTTMSRCAKDLFGFAIMFFIIFLAYAQLAYLVFGTQVDDFSTFQECIFTQFRIILGDINFAEIEEANRVLGPIYFTTFVFFMFFILLNMFLAIINDTYSEVKSDLAQQKAEMELSDLIRKGYHKALVKLKLKKNTVDDISESLRQGGGKXNFDELRQDXKGKGHTDAEIEAIFTKYDQDGDQEXTEHEHQQMRDDLEKEREDLDLDHSSLPRPMSSRSFPRSLDDSEEDDDEDSGHSSRRRGSISSGVSYEEFQVLVRRVDRMEHSIGSIVSKIDAVIVKLEIMERAKLKRREVLGRLLDGVAEDERLGRDSEIHREQMERLVREELERWESDDAASQISHGLGTPVGLNGQPRPRSSRPSSSQSTEGMEGAGGNGSSNVHV

SEQ ID NO: 681 - protein, 643 aa, Homo sapiens
  SITE (88)..(88): Xaa at position 88 is Ala, Gly, or Pro
  SITE (91)..(91): Xaa at position 91 is Val, Ala, Gly, Leu, or Ile
  SITE (105)..(105): Xaa at position 105 is Leu, Ala, Val, Gly, or Ile
  SITE (107)..(107): Xaa at position 107 is Val, Ala, Gly, Leu, or Ile
  SITE (112)..(112): Xaa at position 112 is Leu, Ala, Val, Gly, or Ile
  SITE (114)..(114): Xaa at position 114 is Phe, Tyr, Met, His, Ile, Leu, Val Ala, or Gly
  SITE (127)..(127): Xaa at position 127 is Ala, Gly, or Pro
  SITE (129)..(129): Xaa at position 129 is Leu, Ala, Val, Gly, or Ile
  SITE (131)..(131): Xaa at position 131 is Val, Ala, Gly, Leu, or Ile
  SITE (132)..(132): Xaa at position 132 is Ile, Ala, Val, Leu, or Gly
  SITE (151)..(151): Xaa at position 151 is Leu, Ala, Val, Gly, or Ile
  SITE (158)..(158): Xaa at position 158 is Ile, Ala, Val, Leu, or Gly
  SITE (161)..(161): Xaa at position 161 is Leu, Ala, Val, Gly, or Ile
  SITE (163)..(163): Xaa at position 163 is Phe, Tyr, Met, His, Ile, Leu, Val Ala, or Gly
  SITE (164)..(164): Xaa at position 164 is Ala, Gly, or Pro
  SITE (175)..(175): Xaa at position 175 is Ile, Ala, Val, Leu, or Gly
  SITE (179)..(179): Xaa at position 179 is Leu, Ala, Val, Gly, or Ile
  SITE (184)..(184): Xaa at position 184 is Phe, Tyr, Met, His, Ile, Leu, Val Ala, or Gly
  SITE (194)..(194): Xaa at position 194 is Ala, Gly, or Pro
  SITE (225)..(225): Xaa at position 225 is Trp, Tyr, Phe, Met, His, Ile, Leu Val, Ala, or Gly
  SITE (227)..(227): Xaa at position 227 is Ile, Ala, Val, Leu, or Gly
  SITE (237)..(237): Xaa at position 237 is Cys, Ala, Val, Gly, Ser, or Thr
  SITE (240)..(240): Xaa at position 240 is Tyr, Phe, Met, His, Ile, Leu, Val Ala, or Gly
  SITE (244)..(244): Xaa at position 244 is Leu, Ala, Val, Gly, or Ile
  SITE (245)..(245): Xaa at position 245 is Val, Ala, Gly, Leu, or Ile
  SITE (246)..(246): Xaa at position 246 is Val, Ala, Gly, Leu, or Ile
  SITE (250)..(250): Xaa at position 250 is Ile, Ala, Val, Leu, or Gly
  SITE (255)..(255): Xaa at position 255 is Leu, Ala, Val, Gly, or Ile
  SITE (258)..(258): Xaa at position 258 is Val, Ala, Gly, Leu, or Ile
  SITE (267)..(267): Xaa at position 267 is Ile, Ala, Val, Leu, or Gly
  SITE (269)..(269): Xaa at position 269 is Val, Ala, Gly, Leu, or Ile
  SITE (270)..(270): Xaa at position 270 is Leu, Ala, Val, Gly, or Ile
  SITE (279)..(279): Xaa at position 279 is Ala, Gly, or Pro
  SITE (281)..(281): Xaa at position 281 is Ile, Ala, Val, Leu, or Gly
  SITE (284)..(284): Xaa at position 284 is Cys, Ala, Val, Gly, Ser, or Thr
  SITE (302)..(302): Xaa at position 302 is Tyr, Phe, Met, His, Ile, Leu, Val Ala, or Gly
  SITE (303)..(303): Xaa at position 303 is Leu, Ala, Val, Gly, or Ile
  SITE (305)..(305): Xaa at position 305 is Ala, Gly, or Pro
  SITE (306)..(306): Xaa at position 306 is Ile, Ala, Val, Leu, or Gly
  SITE (316)..(316): Xaa at position 316 is Ile, Ala, Val, Leu, or Gly
  SITE (318)..(318): Xaa at position 318 is Ile, Ala, Val, Leu, or Gly
  SITE (319)..(319): Xaa at position 319 is Phe, Tyr, Met, His, Ile, Leu, Val Ala, or Gly
  SITE (321)..(321): Xaa at position 321 is Ala, Gly, or Pro
  SITE (327)..(327): Xaa at position 327 is Ala, Gly, or Pro
  SITE (353)..(353): Xaa at position 353 is Ile, Ala, Val, Leu, or Gly
  SITE (363)..(363): Xaa at position 363 is Leu, Ala, Val, Gly, or Ile
  SITE (366)..(366): Xaa at position 366 is Leu, Ala, Val, Gly, or Ile
  SITE (371)..(371): Xaa at position 371 is Tyr, Phe, Met, His, Ile, Leu, Val Ala, or Gly
  SITE (388)..(388): Xaa at position 388 is Trp, Tyr, Phe, Met, His, Ile, Leu Val, Ala, or Gly
  SITE (392)..(392): Xaa at position 392 is Ile, Ala, Val, Leu, or Gly
  SITE (395)..(395): Xaa at position 395 is Ile, Ala, Val, Leu, or Gly
  SITE (396)..(396): Xaa at position 396 is Leu, Ala, Val, Gly, or Ile
  SITE (399)..(399): Xaa at position 399 is Ala, Gly, or Pro
  SITE (402)..(402): Xaa at position 402 is Ile, Ala, Val, Leu, or Gly
  SITE (403)..(403): Xaa at position 403 is Ala, Gly, or Pro
  SITE (406)..(406): Xaa at position 406 is Val, Ala, Gly, Leu, or Ile
  SITE (413)..(413): Xaa at position 413 is Val, Ala, Gly, Leu, or Ile
  SITE (414)..(414): Xaa at position 414 is Val, Ala, Gly, Leu, or Ile
  SITE (415)..(415): Xaa at position 415 is Val, Ala, Gly, Leu, or Ile
  SITE (416)..(416): Xaa at position 416 is His, Phe, Tyr, Lys, Arg, Gly, Ser Thr, Ala, Val, Leu, Ile, Asn, Met, or Gln
  SITE (425)..(425): Xaa at position 425 is Ala, Gly, or Pro
  SITE (427)..(427): Xaa at position 427 is Leu, Ala, Val, Gly, or Ile
  SITE (430)..(430): Xaa at position 430 is Leu, Ala, Val, Gly, or Ile
  SITE (431)..(431): Xaa at position 431 is Ala, Gly, or Pro
  SITE (432)..(432): Xaa at position 432 is Met, Ile, Leu, Val, Ala, or Gly
  SITE (433)..(433): Xaa at position 433 is Leu, Ala, Val, Gly, or Ile
  SITE (434)..(434): Xaa at position 434 is Met, Ile, Leu, Val, Ala, or Gly
  SITE (435)..(435): Xaa at position 435 is Leu, Ala, Val, Gly, or Ile
  SITE (439)..(439): Xaa at position 439 is Tyr, Phe, Met, His, Ile, Leu, Val Ala, or Gly
  SITE (442)..(442): Xaa at position 442 is Ile, Ala, Val, Leu, or Gly
  SITE (445)..(445): Xaa at position 445 is Phe, Tyr, Met, His, Ile, Leu, Val Ala, or Gly
  SITE (447)..(447): Xaa at position 447 is Val, Ala, Gly, Leu, or Ile
  SITE (448)..(448): Xaa at position 448 is Leu, Ala, Val, Gly, or Ile
  SITE (449)..(449): Xaa at position 449 is Val, Ala, Gly, Leu, or Ile
  SITE (453)..(453): Xaa at position 453 is Trp, Tyr, Phe, Met, His, Ile, Leu Val, Ala, or Gly
  SITE (456)..(456): Xaa at position 456 is Phe, Tyr, Met, His, Ile, Leu, Val Ala, or Gly
  SITE (458)..(458): Xaa at position 458 is His, Phe, Tyr, Lys, Arg, Gly, Ser Thr, Ala, Val, Leu, Ile, Asn, Met, or Gln
  SITE (460)..(460): Xaa at position 460 is Phe, Tyr, Met, His, Ile, Leu, Val Ala, or Gly
  SITE (466)..(466): Xaa at position 466 is His, Phe, Tyr, Lys, Arg, Gly, Ser Thr, Ala, Val, Leu, Ile, Asn, Met, or Gln
  SITE (472)..(472): Xaa at position 472 is Ala, Gly, or Pro
  SITE (480)..(480): Xaa at position 480 is Phe, Tyr, Met, His, Ile, Leu, Val Ala, or Gly
  SITE (481)..(481): Xaa at position 481 is Leu, Ala, Val, Gly, or Ile
  SITE (483)..(483): Xaa at position 483 is Phe, Tyr, Met, His, Ile, Leu, Val Ala, or Gly
  SITE (484)..(484): Xaa at position 484 is Ile, Ala, Val, Leu, or Gly
  SITE (486)..(486): Xaa at position 486 is Cys, Ala, Val, Gly, Ser, or Thr
  SITE (487)..(487): Xaa at position 487 is Val, Ala, Gly, Leu, or Ile
  SITE (490)..(490): Xaa at position 490 is Met, Ile, Leu, Val, Ala, or Gly
  SITE (497)..(497): Xaa at position 497 is Ala, Gly, or Pro
  SITE (498)..(498): Xaa at position 498 is Phe, Tyr, Met, His, Ile, Leu, Val Ala, or Gly
  SITE (504)..(504): Xaa at position 504 is Phe, Tyr, Met, His, Ile, Leu, Val Ala, or Gly
  SITE (505)..(505): Xaa at position 505 is Leu, Ala, Val, Gly, or Ile
  SITE (508)..(508): Xaa at position 508 is Ile, Ala, Val, Leu, or Gly
  SITE (509)..(509): Xaa at position 509 is Leu, Ala, Val, Gly, or Ile
  SITE (517)..(517): Xaa at position 517 is Phe, Tyr, Met, His, Ile, Leu, Val Ala, or Gly
  SITE (520)..(520): Xaa at position 520 is Phe, Tyr, Met, His, Ile, Leu, Val Ala, or Gly
  SITE (521)..(521): Xaa at position 521 is Leu, Ala, Val, Gly, or Ile
  SITE (533)..(533): Xaa at position 533 is Leu, Ala, Val, Gly, or Ile
  SITE (540)..(540): Xaa at position 540 is Leu, Ala, Val, Gly, or Ile
  SITE (541)..(541): Xaa at position 541 is Trp, Tyr, Phe, Met, His, Ile, Leu Val, Ala, or Gly
  SITE (544)..(544): Xaa at position 544 is Ile, Ala, Val, Leu, or Gly
  SITE (551)..(551): Xaa at position 551 is Phe, Tyr, Met, His, Ile, Leu, Val Ala, or Gly
  SITE (564)..(564): Xaa at position 564 is Leu, Ala, Val, Gly, or Ile
  SITE (576)..(576): Xaa at position 576 is Trp, Tyr, Phe, Met, His, Ile, Leu Val, Ala, or Gly
  SITE (579)..(579): Xaa at position 579 is Tyr, Phe, Met, His, Ile, Leu, Val Ala, or Gly
  SITE (580)..(580): Xaa at position 580 is Tyr, Phe, Met, His, Ile, Leu, Val Ala, or Gly
  SITE (581)..(581): Xaa at position 581 is Ile, Ala, Val, Leu, or Gly
MEKSSSCESLGSQPAAARPPSVDSLSSASTSHSENSVHTKSASVVSSDSISTSADNFSPDLRVLRESNKLAEMEEPPLLPGENIKDMXKDXTYICPFTGAVRGTXTXTNYRXYXKSMERDPPFVLDXSXGXXNRVEKIGGASSRGENSYGXETVCKDXRNXRXXHKPEGRTRRSXFENXMKYAXPVSNNLPLFXFEYKEVFPENGWKLYDPLLEYRRQGIPNESXRXTKINERYELXDTXPALXXXPANXPDEEXKRXASFRSRGRXPXXSWIHPESQXTXTRXSQPMVGVSGKRSKEDEKXXQXXMDSNAQSHKXFXXDXRPSVNXVANKAKGGGYESEDAYQNAELVFLDXHNIHVMRESXRKXKEIVXPNIEETHWLSNLESTHXLEHXKLXXAGXLRXXDKXESGKTSXXXXCSDGWDRTXQXTSXXXXXXDGYXRTXRGXEXXXEKEXLSXGXRXQLRVGXGDKNHXDADRSPVXXQXXDXXWQXTRQFPTXXEFNEYXXITXXDHLYSCLXGTXXCNSEQQRGKENXPKRTVSXXSYXNSQLEDXTNPLYGSYSNHVXYPVASMRHLELXVGXXXRWNPRMKPQEPIHNRYKELLAKRAELQKKVEELQREISNRSTSSSERASSPAQCVTPVQTVV

SEQ ID NO: 682 - protein, 913 aa, Homo sapiens
  SITE (220)..(220): Xaa at position 220 is Leu, Ala, Val, Gly, or Ile
  SITE (223)..(223): Xaa at position 223 is Ala, Gly, or Pro
  SITE (224)..(224): Xaa at position 224 is Val, Ala, Gly, Leu, or Ile
  SITE (226)..(226): Xaa at position 226 is Ala, Gly, or Pro
  SITE (240)..(240): Xaa at position 240 is Leu, Ala, Val, Gly, or Ile
  SITE (243)..(243): Xaa at position 243 is Ala, Gly, or Pro
  SITE (244)..(244): Xaa at position 244 is Val, Ala, Gly, Leu, or Ile
  SITE (256)..(256): Xaa at position 256 is Leu, Ala, Val, Gly, or Ile
  SITE (260)..(260): Xaa at position 260 is Leu, Ala, Val, Gly, or Ile
  SITE (264)..(264): Xaa at position 264 is Cys, Ala, Val, Gly, Ser, or Thr
  SITE (286)..(286): Xaa at position 286 is Leu, Ala, Val, Gly, or Ile
  SITE (289)..(289): Xaa at position 289 is Ile, Ala, Val, Leu, or Gly
  SITE (300)..(300): Xaa at position 300 is Met, Ile, Leu, Val, Ala, or Gly
  SITE (303)..(303): Xaa at position 303 is Ile, Ala, Val, Leu, or Gly
  SITE (306)..(306): Xaa at position 306 is Ile, Ala, Val, Leu, or Gly
  SITE (307)..(307): Xaa at position 307 is Phe, Tyr, Met, His, Ile, Leu, Val Ala, or Gly
  SITE (310)..(310): Xaa at position 310 is Leu, Ala, Val, Gly, or Ile
  SITE (315)..(315): Xaa at position 315 is Val, Ala, Gly, Leu, or Ile
  SITE (324)..(324): Xaa at position 324 is Ile, Ala, Val, Leu, or Gly
  SITE (327)..(327): Xaa at position 327 is Met, Ile, Leu, Val, Ala, or Gly
  SITE (332)..(332): Xaa at position 332 is Phe, Tyr, Met, His, Ile, Leu, Val Ala, or Gly
  SITE (336)..(336): Xaa at position 336 is Ile, Ala, Val, Leu, or Gly
  SITE (337)..(337): Xaa at position 337 is Ile, Ala, Val, Leu, or Gly
  SITE (342)..(342): Xaa at position 342 is Val, Ala, Gly, Leu, or Ile
  SITE (347)..(347): Xaa at position 347 is Ile, Ala, Val, Leu, or Gly
  SITE (350)..(350): Xaa at position 350 is Ile, Ala, Val, Leu, or Gly
  SITE (351)..(351): Xaa at position 351 is Leu, Ala, Val, Gly, or Ile
  SITE (354)..(354): Xaa at position 354 is Ile, Ala, Val, Leu, or Gly
  SITE (368)..(368): Xaa at position 368 is Leu, Ala, Val, Gly, or Ile
  SITE (371)..(371): Xaa at position 371 is Leu, Ala, Val, Gly, or Ile
  SITE (372)..(372): Xaa at position 372 is Leu, Ala, Val, Gly, or Ile
  SITE (374)..(374): Xaa at position 374 is Met, Ile, Leu, Val, Ala, or Gly
  SITE (375)..(375): Xaa at position 375 is Leu, Ala, Val, Gly, or Ile
  SITE (378)..(378): Xaa at position 378 is Leu, Ala, Val, Gly, or Ile
  SITE (381)..(381): Xaa at position 381 is Tyr, Phe, Met, His, Ile, Leu, Val Ala, or Gly
  SITE (385)..(385): Xaa at position 385 is Phe, Tyr, Met, His, Ile, Leu, Val Ala, or Gly
  SITE (389)..(389): Xaa at position 389 is Phe, Tyr, Met, His, Ile, Leu, Val Ala, or Gly
  SITE (397)..(397): Xaa at position 397 is Tyr, Phe, Met, His, Ile, Leu, Val Ala, or Gly
  SITE (410)..(410): Xaa at position 410 is Val, Ala, Gly, Leu, or Ile
  SITE (413)..(413): Xaa at position 413 is Tyr, Phe, Met, His, Ile, Leu, Val Ala, or Gly
  SITE (414)..(414): Xaa at position 414 is Leu, Ala, Val, Gly, or Ile
  SITE (417)..(417): Xaa at position 417 is Val, Ala, Gly, Leu, or Ile
  SITE (421)..(421): Xaa at position 421 is Leu, Ala, Val, Gly, or Ile
  SITE (428)..(428): Xaa at position 428 is Leu, Ala, Val, Gly, or Ile
  SITE (440)..(440): Xaa at position 440 is Leu, Ala, Val, Gly, or Ile
  SITE (444)..(444): Xaa at position 444 is Val, Ala, Gly, Leu, or Ile
  SITE (448)..(448): Xaa at position 448 is Leu, Ala, Val, Gly, or Ile
  SITE (449)..(449): Xaa at position 449 is Leu, Ala, Val, Gly, or Ile
  SITE (456)..(456): Xaa at position 456 is Ile, Ala, Val, Leu, or Gly
  SITE (457)..(457): Xaa at position 457 is Leu, Ala, Val, Gly, or Ile
  SITE (461)..(461): Xaa at position 461 is Leu, Ala, Val, Gly, or Ile
  SITE (464)..(464): Xaa at position 464 is Leu, Ala, Val, Gly, or Ile
  SITE (465)..(465): Xaa at position 465 is Leu, Ala, Val, Gly, or Ile
  SITE (473)..(473): Xaa at position 473 is Leu, Ala, Val, Gly, or Ile
  SITE (476)..(476): Xaa at position 476 is Leu, Ala, Val, Gly, or Ile
  SITE (479)..(479): Xaa at position 479 is Leu, Ala, Val, Gly, or Ile
  SITE (480)..(480): Xaa at position 480 is Phe, Tyr, Met, His, Ile, Leu, Val Ala, or Gly
  SITE (490)..(490): Xaa at position 490 is Leu, Ala, Val, Gly, or Ile
  SITE (494)..(494): Xaa at position 494 is Trp, Tyr, Phe, Met, His, Ile, Leu Val, Ala, or Gly
  SITE (498)..(498): Xaa at position 498 is Ile, Ala, Val, Leu, or Gly
  SITE (505)..(505): Xaa at position 505 is Ile, Ala, Val, Leu, or Gly
  SITE (506)..(506): Xaa at position 506 is Val, Ala, Gly, Leu, or Ile
  SITE (515)..(515): Xaa at position 515 is Met, Ile, Leu, Val, Ala, or Gly
  SITE (516)..(516): Xaa at position 516 is Val, Ala, Gly, Leu, or Ile
  SITE (519)..(519): Xaa at position 519 is Leu, Ala, Val, Gly, or Ile
  SITE (520)..(520): Xaa at position 520 is Leu, Ala, Val, Gly, or Ile
  SITE (526)..(526): Xaa at position 526 is Val, Ala, Gly, Leu, or Ile
  SITE (529)..(529): Xaa at position 529 is Ile, Ala, Val, Leu, or Gly
  SITE (532)..(532): Xaa at position 532 is Ile, Ala, Val, Leu, or Gly
  SITE (533)..(533): Xaa at position 533 is Cys, Ala, Val, Gly, Ser, or Thr
  SITE (534)..(534): Xaa at position 534 is Phe, Tyr, Met, His, Ile, Leu, Val Ala, or Gly
  SITE (540)..(540): Xaa at position 540 is Phe, Tyr, Met, His, Ile, Leu, Val Ala, or Gly
  SITE (543)..(543): Xaa at position 543 is Ala, Gly, or Pro
  SITE (544)..(544): Xaa at position 544 is Met, Ile, Leu, Val, Ala, or Gly
  SITE (547)..(547): Xaa at position 547 is Ala, Gly, or Pro
  SITE (548)..(548): Xaa at position 548 is Phe, Tyr, Met, His, Ile, Leu, Val Ala, or Gly
  SITE (551)..(551): Xaa at position 551 is Phe, Tyr, Met, His, Ile, Leu, Val Ala, or Gly
  SITE (552)..(552): Xaa at position 552 is Ile, Ala, Val, Leu, or Gly
  SITE (560)..(560): Xaa at position 560 is Ala, Gly, or Pro
  SITE (562)..(562): Xaa at position 562 is Leu, Ala, Val, Gly, or Ile
  SITE (563)..(563): Xaa at position 563 is Ile, Ala, Val, Leu, or Gly
  SITE (564)..(564): Xaa at position 564 is Ala, Gly, or Pro
  SITE (567)..(567): Xaa at position 567 is Val, Ala, Gly, Leu, or Ile
  SITE (571)..(571): Xaa at position 571 is Leu, Ala, Val, Gly, or Ile
  SITE (587)..(587): Xaa at position 587 is Leu, Ala, Val, Gly, or Ile
  SITE (590)..(590): Xaa at position 590 is Ile, Ala, Val, Leu, or Gly
  SITE (593)..(593): Xaa at position 593 is Ile, Ala, Val, Leu, or Gly
  SITE (594)..(594): Xaa at position 594 is Phe, Tyr, Met, His, Ile, Leu, Val Ala, or Gly
  SITE (597)..(597): Xaa at position 597 is Ile, Ala, Val, Leu, or Gly
  SITE (602)..(602): Xaa at position 602 is Val, Ala, Gly, Leu, or Ile
  SITE (603)..(603): Xaa at position 603 is Phe, Tyr, Met, His, Ile, Leu, Val Ala, or Gly
  SITE (606)..(606): Xaa at position 606 is Phe, Tyr, Met, His, Ile, Leu, Val Ala, or Gly
  SITE (607)..(607): Xaa at position 607 is Tyr, Phe, Met, His, Ile, Leu, Val Ala, or Gly
  SITE (611)..(611): Xaa at position 611 is Leu, Ala, Val, Gly, or Ile
  SITE (612)..(612): Xaa at position 612 is Ala, Gly, or Pro
  SITE (629)..(629): Xaa at position 629 is Met, Ile, Leu, Val, Ala, or Gly
  SITE (633)..(633): Xaa at position 633 is Leu, Ala, Val, Gly, or Ile
  SITE (645)..(645): Xaa at position 645 is Leu, Ala, Val, Gly, or Ile
  SITE (648)..(648): Xaa at position 648 is Met, Ile, Leu, Val, Ala, or Gly
  SITE (708)..(708): Xaa at position 708 is Phe, Tyr, Met, His, Ile, Leu, Val Ala, or Gly
  SITE (711)..(711): Xaa at position 711 is Phe, Tyr, Met, His, Ile, Leu, Val Ala, or Gly
  SITE (734)..(734): Xaa at position 734 is Ala, Gly, or Pro
  SITE (743)..(743): Xaa at position 743 is Leu, Ala, Val, Gly, or Ile
  SITE (745)..(745): Xaa at position 745 is Val, Ala, Gly, Leu, or Ile
  SITE (748)..(748): Xaa at position 748 is Phe, Tyr, Met, His, Ile, Leu, Val Ala, or Gly
  SITE (752)..(752): Xaa at position 752 is Val, Ala, Gly, Leu, or Ile
  SITE (767)..(767): Xaa at position 767 is Ile, Ala, Val, Leu, or Gly
  SITE (778)..(778): Xaa at position 778 is Leu, Ala, Val, Gly, or Ile
  SITE (782)..(782): Xaa at position 782 is Leu, Ala, Val, Gly, or Ile
  SITE (785)..(785): Xaa at position 785 is Leu, Ala, Val, Gly, or Ile
  SITE (786)..(786): Xaa at position 786 is Ala, Gly, or Pro
  SITE (808)..(808): Xaa at position 808 is Phe, Tyr, Met, His, Ile, Leu, Val Ala, or Gly
  SITE (823)..(823): Xaa at position 823 is Ile, Ala, Val, Leu, or Gly
  SITE (850)..(850): Xaa at position 850 is Ile, Ala, Val, Leu, or Gly
  SITE (853)..(853): Xaa at position 853 is Ala, Gly, or Pro
  SITE (854)..(854): Xaa at position 854 is Ile, Ala, Val, Leu, or Gly
  SITE (858)..(858): Xaa at position 858 is Met, Ile, Leu, Val, Ala, or Gly
  SITE (869)..(869): Xaa at position 869 is Leu, Ala, Val, Gly, or Ile
  SITE (873)..(873): Xaa at position 873 is Val, Ala, Gly, Leu, or Ile
  SITE (886)..(886): Xaa at position 886 is Leu, Ala, Val, Gly, or Ile
  SITE (890)..(890): Xaa at position 890 is Ile, Ala, Val, Leu, or Gly
  SITE (893)..(893): Xaa at position 893 is Leu, Ala, Val, Gly, or Ile
  SITE (899)..(899): Xaa at position 899 is Met, Ile, Leu, Val, Ala, or Gly
  SITE (909)..(909): Xaa at position 909 is Tyr, Phe, Met, His, Ile, Leu, Val Ala, or Gly
MMSQSSGSGDGNDDEATTSKDGGFSSPSPSAAAAAQEVRSATDGNTSTTPPTSAKKRKLNSSSSSSSNSSNEREDFDSTSSSSSTPPLQPRDSASPSTSSFCLGVSVAASSHVPIQKKLRFEDTLEFVGFDAKMAEESSSSSSSSSPTAATSQQQQLKNKSILISSVASVHHANGLAKSSTTVSSFANSKPGSAKKLVIKNFKDKPKLPENYTDETWQKXKEXXEXIQNSTSIKYNLEEXYQXXENLCSYKISANXYKQXRQIXEDHIKAQIHQFREDSLDSVLFXKKXDRCWQNHCRQXIMXRSXXLFXDRTYXLQNSMLPSXWDXGLELXRAHXXSDQKXQNKTXDGXXLLXERERNGEAIDRSLXRSXXSXXSDXQIXQDSXEQRXLEETNRLXAAEGQKLMQEREXPEXXHHXNKRXEEEADRXITYLDQTTQKSXIATXEKQXXGEHLTAXXQKGXNNXXDENRIQDXSLXYQXXSRVRGGVQVXLQQXIEYXKAFGSTXXINPEKDKTXXQEXXDFKDKXDHXIDXXXLKNEKXINXXKEXXETXXNKRPNKPXEXXXKYXDSKXRAGNKEATDEELEKMXDKXMIXXRFXYGKDXXEAXXKKDXXKRLLVGKSASVDAEKSXLSKXKHECGAAFTSKXEGXFKDMELSKDIMIQFKQYMQNQNVPGNIELTVNILTMGYWPTYVPMEVHLPPEMVKLQEIXKTXYLGKHSGRKLQWQSTLGHCVLKXEFKEGKKEXQXSLXQTLXLLMFNEGEEFSLEEXKQATGIEDGEXRRTXQSXXCGKARVLAKNPKGKDIEDGDKXICNDDFKHKLFRIKXNQIQMKETVEEQASTTERVFQDRQYQXDAXXVRIXKMRKTLSHNLXVSEXYNQLKFPVKPADXKKRXESXIDRDYXERDKENPNQXNYIA

SEQ ID NO: 683 - protein, 578 aa, Homo sapiens
  SITE (36)..(36): Xaa at position 36 is Ala, Gly, or Pro
  SITE (39)..(39): Xaa at position 39 is Phe, Tyr, Met, His, Ile, Leu, Val Ala, or Gly
  SITE (41)..(41): Xaa at position 41 is His, Phe, Tyr, Lys, Arg, Gly, Ser Thr, Ala, Val, Leu, Ile, Asn, Met, or Gln
  SITE (43)..(43): Xaa at position 43 is Leu, Ala, Val, Gly, or Ile
  SITE (59)..(59): Xaa at position 59 is Val, Ala, Gly, Leu, or Ile
  SITE (60)..(60): Xaa at position 60 is Ala, Gly, or Pro
  SITE (83)..(83): Xaa at position 83 is Leu, Ala, Val, Gly, or Ile
  SITE (98)..(98): Xaa at position 98 is Ala, Gly, or Pro
  SITE (100)..(100): Xaa at position 100 is Val, Ala, Gly, Leu, or Ile
  SITE (102)..(102): Xaa at position 102 is Ala, Gly, or Pro
  SITE (118)..(118): Xaa at position 118 is Phe, Tyr, Met, His, Ile, Leu, Val Ala, or Gly
  SITE (123)..(123): Xaa at position 123 is Val, Ala, Gly, Leu, or Ile
  SITE (125)..(125): Xaa at position 125 is Leu, Ala, Val, Gly, or Ile
  SITE (130)..(130): Xaa at position 130 is Val, Ala, Gly, Leu, or Ile
  SITE (157)..(157): Xaa at position 157 is Tyr, Phe, Met, His, Ile, Leu, Val Ala, or Gly
  SITE (161)..(161): Xaa at position 161 is Phe, Tyr, Met, His, Ile, Leu, Val Ala, or Gly
  SITE (167)..(167): Xaa at position 167 is Tyr, Phe, Met, His, Ile, Leu, Val Ala, or Gly
  SITE (169)..(169): Xaa at position 169 is Ile, Ala, Val, Leu, or Gly
  SITE (203)..(203): Xaa at position 203 is Val, Ala, Gly, Leu, or Ile
  SITE (205)..(205): Xaa at position 205 is Val, Ala, Gly, Leu, or Ile
  SITE (209)..(209): Xaa at position 209 is Val, Ala, Gly, Leu, or Ile
MLPCLVVLLAALLSLRLGSDAHGTELPSPPSVWFEXEFXHXIXHWTPIPNQSESTCYEXXLLRYGIESWNSISNCSQTLSYDXTAVTLDLYHSNGYRXRXRXVDGSRHSNWTVTNTRXSVDEXTXTVGSXNLEIHNGFILGKIQLPRPKMAPANDTXESIXSHFREXEXAIRKVPGNFTFTHKKVKHENFSLLTSGEVGEFCXQXKPSXASRSNKGMWSKEECISLTRQYFTVTNVIIFFAFVLLLSGALAYCLALQLYVRRRKKLPSVLLFKKPSPFIFISQRPSPETQDTIHPLDEEAFLKVSPELKNLDLHGSTDSGFGSTKPSLQTEEPQFLLPDPHPQADRTLGNREPPVLGDSCSSGSSNSTDSGICLQEPSLSPSTGPTWEQQVGSNSRGQDDSGIDLVQNSEGRAGDTQGGSALGHHSPPEPEVPGEEDPAAVAFQGYLRQTRCAEEKATKTGCLEEESPLTDGLGPKFGRCLVDEAGLHPPALAKGYLKQDPLEMTLASSGAPTGQWNQPTEEWSLLALSSCSDLGISDWSFAHDLAPLGCVAAPGGLLGSFNSDLVTLPLISSLQSSE

SEQ ID NO: 684 - protein, 1873 aa, Homo sapiens
  SITE (603)..(603): Xaa at position 603 is Ala, Gly, or Pro
  SITE (610)..(610): Xaa at position 610 is Val, Ala, Gly, Leu, or Ile
  SITE (1010)..(1010): Xaa at position 1010 is Val, Ala, Gly, Leu, or Ile
  SITE (1023)..(1023): Xaa at position 1023 is Ala, Gly, or Pro
  SITE (1312)..(1312): Xaa at position 1312 is Ala, Gly, or Pro
  SITE (1329)..(1329): Xaa at position 1329 is Leu, Ala, Val, Gly, or Ile
MEPSSPQDEGLRKKQPKKPVPEILPRPPRALFCLTLENPLRKACISIVEWKPFETIILLTIFANCVALAVYLPMPEDDNNSLNLGLEKLEYFFLIVFSIEAAMKIIAYGFLFHQDAYLRSGWNVLDFTIVFLGVFTVILEQVNVIQSHTAPMSSKGAGLDVKALRAFRVLRPLRLVSGVPSLQVVLNSIFKAMLPLFHIALLVLFMVIIYAIIGLELFKGKMHKTCYFIGTDIVATVENEEPSPCARTGSGRRCTINGSECRGGWPGPNHGITHFDNFGFSMLTVYQCITMEGWTDVLYWVNDAIGNEWPWIYFVTLILLGSFFILNLVLGVLSGEFTKEREKAKSRGTFQKLREKQQLDEDLRGYMSWITQGEVMDVEDFREGKLSLDEGGSDTESLYEIAGLNKIIQFIRHWRQWNRIFRWKCHDIVKSKVFYWLVILIVALNTLSIASEHHNQPLWLTRLQDIANRVLLSLFTTEMLMKMYGLGLRQYFMSIFNRFDCFVVCSGILEILLVESGAMTPLGISVLRCIRLLRIFKITKYWTSLSNLVASLLNSIRSIASLLLLLFLFIVIFALLGMQLFGGRYDFEDTEVRRSNFDNFPQXLISVFQXLTGEDWTSMMYNGIMAYGGPSYPGMLVCIYFIILFVCGNYILLNVFLAIAVDNLAEAESLTSAQKAKAEEKKRRKMSKGLPDKSEEEKSTMAKKLEQKPKGEGIPTTAKLKIDEFESNVNEVKDPYPSADFPGDDEEDEPEIPLSPRPRPLAELQLKEKAVPIPEASSFFIFSPTNKIRVLCHRIVNATWFTNFILLFILLSSAALAAEDPIRADSMRNQILKHFDIGFTSVFTVEIVLKMTTYGAFLHKGSFCRNYFNMLDLLVVAVSLISMGLESSAISVVKILRVLRVLRPLRAINRAKGLKHVVQCMFVAISTIGNIVLVTTLLQFMFACIGVQLFKGKFFRCTDLSKMTEEECRGYYYVYKDGDPMQIELRHREWVHSDFHFDNVLSAMMSLFTXSTFEGWPQLLYKXIDSNAEDVGPIYNNRVEMAIFFIIYIILIAFFMMNIFVGFVIVTFQEQGETEYKNCELDKNQRQCVQYALKARPLRCYIPKNPYQYQVWYIVTSSYFEYLMFALIMLNTICLGMQHYNQSEQMNHISDILNVAFTIIFTLEMILKLMAFKARGYFGDPWNVFDFLIVIGSIIDVILSEIDTFLASSGGLYCLGGGCGNVDPDESARISSAFFRLFRVMRLIKLLSRAEGVRTLLWTFIKSFQALPYVALLIVMLFFIYAVIGMQMFGKIALVDGTQINRNNNFQTFPQXVLLLFRCATGEAWQEIXLACSYGKLCDPESDYAPGEEYTCGTNFAYYYFISFYMLCAFLVINLFVAVIMDNFDYLTRDWSILGPHHLDEFKAIWAEYDPEAKGRIKHLDVVTLLRRIQPPLGFGKFCPHRVACKRLVGMNMPLNSDGTVTFNATLFALVRTALKIKTEGNFEQANEELRAIIKKIWKRTSMKLLDQVIPPIGDDEVTVGKFYATFLIQEHFRKFMKRQEEYYGYRPKKDIVQIQAGLRTIEEEAAPEICRTVSGDLAAEEELERAMVEAAMEEGIFRRTGGLFGQVDNFLERTNSLPPVMANQRPLQFAEIEMEEMESPVFLEDFPQDPRTNPLARANTNNANANVAYGNSNHSNSHVFSSVHYEREFPEETETPATRGRALGQPCRVLGPHSKPCVEMLKGLLTQRAMPRGQAPPAPCQCPRVESSMPEDRKSSTPGSLHEETPHSRSTRENTSRCSAPATALLIQKALVRGGLGTLAADANFIMATGQALADACQMEPEEVEIMATELLKGREAPEGMASSLGCLNLGSSLGSLDQHQGSQETLIPPRL

SEQ ID NO: 685 - protein, 1193 aa, Homo sapiens
  SITE (550)..(550): Xaa at position 550 is Cys, Ala, Val, Gly, Ser, or Thr
  SITE (570)..(570): Xaa at position 570 is Cys, Ala, Val, Gly, Ser, or Thr
MPALWLGCCLCFSLLLPAARATSRREVCDCNGKSRQCIFDRELHRQTGNGFRCLNCNDNTDGIHCEKCKNGFYRHRERDRCLPCNCNSKGSLSARCDNSGRCSCKPGVTGARCDRCLPGFHMLTDAGCTQDQRLLDSKCDCDPAGIAGPCDAGRCVCKPAVTGERCDRCRSGYYNLDGGNPEGCTQCFCYGHSASCRSSAEYSVHKITSTFHQDVDGWKAVQRNGSPAKLQWSQRHQDVFSSAQRLDPVYFVAPAKFLGNQQVSYGQSLSFDYRVDRGGRHPSAHDVILEGAGLRITAPLMPLGKTLPCGLTKTYTFRLNEHPSNNWSPQLSYFEYRRLLRNLTALRIRATYGEYSTGYIDNVTLISARPVSGAPAPWVEQCICPVGYKGQFCQDCASGYKRDSARLGPFGTCIPCNCQGGGACDPDTGDCYSGDENPDIECADCPIGFYNDPHDPRSCKPCPCHNGFSCSVMPETEEVVCNNCPPGVTGARCELCADGYFGDPFGEHGPVRPCQPCQCNNNVDPSASGNCDRLTGRCLKCIHNTAGIYXDQCKAGYFGDPLAPNPADKXRACNCNPMGSEPVGCRSDGTCVCKPGFGGPNCEHGAFSCPACYNQVKIQMDQFMQQLQRMEALISKAQGGDGVVPDTELEGRMQQAEQALQDILRDAQISEGASRSLGLQLAKVRSQENSYQSRLDDLKMTVERVRALGSQYQNRVRDTHRLITQMQLSLAESEASLGNTNIPASDHYVGPNGFKSLAQEATRLAESHVESASNMEQLTRETEDYSKQALSLVRKALHEGVGSGSGSPDGAVVQGLVEKLEKTKSLAQQLTREATQAEIEADRSYQHSLRLLDSVSRLQGVSDQSFQVEEAKRIKQKADSLSSLVTRHMDEFKRTQKNLGNWKEEAQQLLQNGKSGREKSDQLLSRANLAKSRAQEALSMGNATFYEVESILKNLREFDLQVDNRKAEAEEAMKRLSYISQKVSDASDKTQQAERALGSAAADAQRAKNGAGEALEISSEIEQEIGSLNLEANVTADGALAMEKGLASLKSEMREVEGELERKELEFDTNMDAVQMVITEAQKVDTRAKNAGVTIQDTLNTLDGLLHLMDQPLSVDEEGLVLLEQKLSRAKTQINSQLRPMMSELEERARQQRGHLHLLETSIDGILADVKNLENIRDNLPPGCYNTQALEQQ

SEQ ID NO: 686 - protein, 863 aa, Homo sapiens
  SITE (59)..(59): Xaa at position 59 is Cys, Ala, Val, Gly, Ser, or Thr
  SITE (76)..(76): Xaa at position 76 is Cys, Ala, Val, Gly, Ser, or Thr
  SITE (80)..(80): Xaa at position 80 is Cys, Ala, Val, Gly, Ser, or Thr
  SITE (90)..(90): Xaa at position 90 is Phe, Tyr, Met, His, Ile, Leu, Val Ala, or Gly
  SITE (94)..(94): Xaa at position 94 is Cys, Ala, Val, Gly, Ser, or Thr
  SITE (118)..(118): Xaa at position 118 is Cys, Ala, Val, Gly, Ser, or Thr
  SITE (120)..(120): Xaa at position 120 is Cys, Ala, Val, Gly, Ser, or Thr
  SITE (124)..(124): Xaa at position 124 is Cys, Ala, Val, Gly, Ser, or Thr
  SITE (130)..(130): Xaa at position 130 is Cys, Ala, Val, Gly, Ser, or Thr
  SITE (131)..(131): Xaa at position 131 is Cys, Ala, Val, Gly, Ser, or Thr
  SITE (144)..(144): Xaa at position 144 is Trp, Tyr, Phe, Met, His, Ile, Leu Val, Ala, or Gly
  SITE (166)..(166): Xaa at position 166 is Leu, Ala, Val, Gly, or Ile
  SITE (167)..(167): Xaa at position 167 is Ile, Ala, Val, Leu, or Gly
  SITE (169)..(169): Xaa at position 169 is Phe, Tyr, Met, His, Ile, Leu, Val Ala, or Gly
  SITE (171)..(171): Xaa at position 171 is Val, Ala, Gly, Leu, or Ile
  SITE (174)..(174): Xaa at position 174 is Phe, Tyr, Met, His, Ile, Leu, Val Ala, or Gly
  SITE (178)..(178): Xaa at position 178 is Tyr, Phe, Met, His, Ile, Leu, Val Ala, or Gly
  SITE (186)..(186): Xaa at position 186 is Met, Ile, Leu, Val, Ala, or Gly
  SITE (189)..(189): Xaa at position 189 is Ile, Ala, Val, Leu, or Gly
  SITE (192)..(192): Xaa at position 192 is Leu, Ala, Val, Gly, or Ile
  SITE (202)..(202): Xaa at position 202 is Met, Ile, Leu, Val, Ala, or Gly
  SITE (206)..(206): Xaa at position 206 is Tyr, Phe, Met, His, Ile, Leu, Val Ala, or Gly
  SITE (222)..(222): Xaa at position 222 is Tyr, Phe, Met, His, Ile, Leu, Val Ala, or Gly
  SITE (226)..(226): Xaa at position 226 is His, Phe, Tyr, Lys, Arg, Gly, Ser Thr, Ala, Val, Leu, Ile, Asn, Met, or Gln
  SITE (228)..(228): Xaa at position 228 is Ile, Ala, Val, Leu, or Gly
  SITE (229)..(229): Xaa at position 229 is Val, Ala, Gly, Leu, or Ile
  SITE (233)..(233): Xaa at position 233 is Met, Ile, Leu, Val, Ala, or Gly
  SITE (242)..(242): Xaa at position 242 is Phe, Tyr, Met, His, Ile, Leu, Val Ala, or Gly
  SITE (254)..(254): Xaa at position 254 is Trp, Tyr, Phe, Met, His, Ile, Leu Val, Ala, or Gly
  SITE (260)..(260): Xaa at position 260 is Leu, Ala, Val, Gly, or Ile
  SITE (264)..(264): Xaa at position 264 is Ala, Gly, or Pro
  SITE (280)..(280): Xaa at position 280 is Ile, Ala, Val, Leu, or Gly
  SITE (286)..(286): Xaa at position 286 is Ile, Ala, Val, Leu, or Gly
  SITE (289)..(289): Xaa at position 289 is Ile, Ala, Val, Leu, or Gly
  SITE (295)..(295): Xaa at position 295 is Leu, Ala, Val, Gly, or Ile
  SITE (303)..(303): Xaa at position 303 is Val, Ala, Gly, Leu, or Ile
  SITE (304)..(304): Xaa at position 304 is Tyr, Phe, Met, His, Ile, Leu, Val Ala, or Gly
  SITE (306)..(306): Xaa at position 306 is Phe, Tyr, Met, His, Ile, Leu, Val Ala, or Gly
  SITE (325)..(325): Xaa at position 325 is Met, Ile, Leu, Val, Ala, or Gly
  SITE (329)..(329): Xaa at position 329 is Leu, Ala, Val, Gly, or Ile
  SITE (336)..(336): Xaa at position 336 is Val, Ala, Gly, Leu, or Ile
  SITE (339)..(339): Xaa at position 339 is Leu, Ala, Val, Gly, or Ile
  SITE (340)..(340): Xaa at position 340 is Met, Ile, Leu, Val, Ala, or Gly
  SITE (343)..(343): Xaa at position 343 is Leu, Ala, Val, Gly, or Ile
  SITE (351)..(351): Xaa at position 351 is Cys, Ala, Val, Gly, Ser, or Thr
  SITE (352)..(352): Xaa at position 352 is Val, Ala, Gly, Leu, or Ile
  SITE (355)..(355): Xaa at position 355 is Ile, Ala, Val, Leu, or Gly
  SITE (356)..(356): Xaa at position 356 is Phe, Tyr, Met, His, Ile, Leu, Val Ala, or Gly
  SITE (357)..(357): Xaa at position 357 is Val, Ala, Gly, Leu, or Ile
  SITE (360)..(360): Xaa at position 360 is His, Phe, Tyr, Lys, Arg, Gly, Ser Thr, Ala, Val, Leu, Ile, Asn, Met, or Gln
  SITE (362)..(362): Xaa at position 362 is Met, Ile, Leu, Val, Ala, or Gly
  SITE (365)..(365): Xaa at position 365 is Val, Ala, Gly, Leu, or Ile
  SITE (367)..(367): Xaa at position 367 is Cys, Ala, Val, Gly, Ser, or Thr
  SITE (372)..(372): Xaa at position 372 is Phe, Tyr, Met, His, Ile, Leu, Val Ala, or Gly
  SITE (373)..(373): Xaa at position 373 is Leu, Ala, Val, Gly, or Ile
  SITE (390)..(390): Xaa at position 390 is Leu, Ala, Val, Gly, or Ile
  SITE (393)..(393): Xaa at position 393 is Ile, Ala, Val, Leu, or Gly
  SITE (409)..(409): Xaa at position 409 is Ile, Ala, Val, Leu, or Gly
  SITE (412)..(412): Xaa at position 412 is Leu, Ala, Val, Gly, or Ile
  SITE (424)..(424): Xaa at position 424 is Tyr, Phe, Met, His, Ile, Leu, Val Ala, or Gly
  SITE (444)..(444): Xaa at position 444 is Ile, Ala, Val, Leu, or Gly
  SITE (445)..(445): Xaa at position 445 is His, Phe, Tyr, Lys, Arg, Gly, Ser Thr, Ala, Val, Leu, Ile, Asn, Met, or Gln
  SITE (446)..(446): Xaa at position 446 is Leu, Ala, Val, Gly, or Ile
  SITE (447)..(447): Xaa at position 447 is Leu, Ala, Val, Gly, or Ile
  SITE (454)..(454): Xaa at position 454 is Val, Ala, Gly, Leu, or Ile
  SITE (477)..(477): Xaa at position 477 is Phe, Tyr, Met, His, Ile, Leu, Val Ala, or Gly
  SITE (484)..(484): Xaa at position 484 is Met, Ile, Leu, Val, Ala, or Gly
  SITE (488)..(488): Xaa at position 488 is Phe, Tyr, Met, His, Ile, Leu, Val Ala, or Gly
  SITE (489)..(489): Xaa at position 489 is Val, Ala, Gly, Leu, or Ile
  SITE (495)..(495): Xaa at position 495 is Phe, Tyr, Met, His, Ile, Leu, Val Ala, or Gly
  SITE (501)..(501): Xaa at position 501 is Val, Ala, Gly, Leu, or Ile
  SITE (504)..(504): Xaa at position 504 is Phe, Tyr, Met, His, Ile, Leu, Val Ala, or Gly
  SITE (507)..(507): Xaa at position 507 is Ile, Ala, Val, Leu, or Gly
  SITE (509)..(509): Xaa at position 509 is Leu, Ala, Val, Gly, or Ile
  SITE (510)..(510): Xaa at position 510 is Tyr, Phe, Met, His, Ile, Leu, Val Ala, or Gly
  SITE (513)..(513): Xaa at position 513 is Met, Ile, Leu, Val, Ala, or Gly
  SITE (514)..(514): Xaa at position 514 is Cys, Ala, Val, Gly, Ser, or Thr
  SITE (517)..(517): Xaa at position 517 is Leu, Ala, Val, Gly, or Ile
  SITE (534)..(534): Xaa at position 534 is Leu, Ala, Val, Gly, or Ile
  SITE (544)..(544): Xaa at position 544 is Met, Ile, Leu, Val, Ala, or Gly
  SITE (603)..(603): Xaa at position 603 is Ala, Gly, or Pro
  SITE (604)..(604): Xaa at position 604 is Val, Ala, Gly, Leu, or Ile
  SITE (610)..(610): Xaa at position 610 is Tyr, Phe, Met, His, Ile, Leu, Val Ala, or Gly
  SITE (613)..(613): Xaa at position 613 is Leu, Ala, Val, Gly, or Ile
  SITE (618)..(618): Xaa at position 618 is Phe, Tyr, Met, His, Ile, Leu, Val Ala, or Gly
  SITE (622)..(622): Xaa at position 622 is Tyr, Phe, Met, His, Ile, Leu, Val Ala, or Gly
  SITE (628)..(628): Xaa at position 628 is Met, Ile, Leu, Val, Ala, or Gly
  SITE (631)..(631): Xaa at position 631 is Trp, Tyr, Phe, Met, His, Ile, Leu Val, Ala, or Gly
  SITE (634)..(634): Xaa at position 634 is Tyr, Phe, Met, His, Ile, Leu, Val Ala, or Gly
  SITE (652)..(652): Xaa at position 652 is Cys, Ala, Val, Gly, Ser, or Thr
  SITE (653)..(653): Xaa at position 653 is Val, Ala, Gly, Leu, or Ile
  SITE (659)..(659): Xaa at position 659 is Val, Ala, Gly, Leu, or Ile
  SITE (669)..(669): Xaa at position 669 is Ala, Gly, or Pro
  SITE (681)..(681): Xaa at position 681 is Leu, Ala, Val, Gly, or Ile
  SITE (682)..(682): Xaa at position 682 is Phe, Tyr, Met, His, Ile, Leu, Val Ala, or Gly
  SITE (692)..(692): Xaa at position 692 is Ala, Gly, or Pro
  SITE (696)..(696): Xaa at position 696 is Ala, Gly, or Pro
  SITE (697)..(697): Xaa at position 697 is Phe, Tyr, Met, His, Ile, Leu, Val Ala, or Gly
  SITE (699)..(699): Xaa at position 699 is Val, Ala, Gly, Leu, or Ile
  SITE (702)..(702): Xaa at position 702 is Met, Ile, Leu, Val, Ala, or Gly
  SITE (703)..(703): Xaa at position 703 is Val, Ala, Gly, Leu, or Ile
  SITE (705)..(705): Xaa at position 705 is Met, Ile, Leu, Val, Ala, or Gly
  SITE (708)..(708): Xaa at position 708 is Ala, Gly, or Pro
  SITE (712)..(712): Xaa at position 712 is Val, Ala, Gly, Leu, or Ile
  SITE (713)..(713): Xaa at position 713 is Trp, Tyr, Phe, Met, His, Ile, Leu Val, Ala, or Gly
  SITE (716)..(716): Xaa at position 716 is Phe, Tyr, Met, His, Ile, Leu, Val Ala, or Gly
  SITE (719)..(719): Xaa at position 719 is Val, Ala, Gly, Leu, or Ile
  SITE (720)..(720): Xaa at position 720 is Leu, Ala, Val, Gly, or Ile
  SITE (721)..(721): Xaa at position 721 is Val, Ala, Gly, Leu, or Ile
  SITE (725)..(725): Xaa at position 725 is Ala, Gly, or Pro
  SITE (731)..(731): Xaa at position 731 is Val, Ala, Gly, Leu, or Ile
  SITE (733)..(733): Xaa at position 733 is Val, Ala, Gly, Leu, or Ile
  SITE (738)..(738): Xaa at position 738 is Ile, Ala, Val, Leu, or Gly
  SITE (739)..(739): Xaa at position 739 is Phe, Tyr, Met, His, Ile, Leu, Val Ala, or Gly
  SITE (757)..(757): Xaa at position 757 is Val, Ala, Gly, Leu, or Ile
  SITE (762)..(762): Xaa at position 762 is Ile, Ala, Val, Leu, or Gly
  SITE (764)..(764): Xaa at position 764 is Val, Ala, Gly, Leu, or Ile
  SITE (768)..(768): Xaa at position 768 is Tyr, Phe, Met, His, Ile, Leu, Val Ala, or Gly
  SITE (769)..(769): Xaa at position 769 is Tyr, Phe, Met, His, Ile, Leu, Val Ala, or Gly
  SITE (771)..(771): Xaa at position 771 is Ile, Ala, Val, Leu, or Gly
  SITE (772)..(772): Xaa at position 772 is Ile, Ala, Val, Leu, or Gly
  SITE (795)..(795): Xaa at position 795 is Ile, Ala, Val, Leu, or Gly
  SITE (796)..(796): Xaa at position 796 is Leu, Ala, Val, Gly, or Ile
  SITE (816)..(816): Xaa at position 816 is Val, Ala, Gly, Leu, or Ile
  SITE (820)..(820): Xaa at position 820 is Met, Ile, Leu, Val, Ala, or Gly
  SITE (823)..(823): Xaa at position 823 is His, Phe, Tyr, Lys, Arg, Gly, Ser Thr, Ala, Val, Leu, Ile, Asn, Met, or Gln
  SITE (825)..(825): Xaa at position 825 is Ala, Gly, or Pro
  SITE (827)..(827): Xaa at position 827 is Val, Ala, Gly, Leu, or Ile
  SITE (830)..(830): Xaa at position 830 is Ile, Ala, Val, Leu, or Gly
  SITE (833)..(833): Xaa at position 833 is Leu, Ala, Val, Gly, or Ile
  SITE (836)..(836): Xaa at position 836 is Leu, Ala, Val, Gly, or Ile
  SITE (838)..(838): Xaa at position 838 is Phe, Tyr, Met, His, Ile, Leu, Val Ala, or Gly
  SITE (849)..(849): Xaa at position 849 is Ile, Ala, Val, Leu, or Gly
  SITE (850)..(850): Xaa at position 850 is Leu, Ala, Val, Gly, or Ile
  SITE (852)..(852): Xaa at position 852 is Leu, Ala, Val, Gly, or Ile
MARRSSFQSCQIISLFTFAVGVNICLGFTAHRIKRAEGWEEGPPTVLSDSPWTNISGSXKGRCFELQEAGPPDCRXDNLXKSYTSCCHDXDELXLKTARGWECTKDRCGEVRNEENAXHXSEDXLARGDXXTNYQVVCKGESHXVDDDCEEIKAAECPAGFVRPPXXIXSXDGXRASXMKKGSKVXPNXEKXRSCGTHSPYXRPVXPTKTFPNLYTLATGLXPESXGXXGNSXYDPVFDATXHLRGREKFNHRXWGGQPXWITXTKQGVKAGTFFWSVVXPHERRXLTXLQWLTXPDHERPSXXAXYSEQPDFSGHKYGPFGPEXTNPXREIDKIXGQXXDGXKQLKLHRXXNVXXXGDXGXEDXTXDRTEXXSNYLTNVDDITLVPGTXGRXRSKFSNNAKYDPKAIXANXTCKKPDQHFKPXLKQHLPKRLHYANNRRIEDXXXXVERRWHXARKPLDVYKKPSGKCFFQGDHGXDNKVNSXQTVXXGYGSTXKYKTKXPPXENXEXXNVXXDLXGLKPAPNNGTHGSLNHXLRTNTFRPTXPEEVTRPNYPGIMYLQSDFDLGCTCDDKVEPKNKLDELNKRLHTKGSTEERHLLYGRPXXLYRTRXDIXYHTDXESGXSEIFLXPLXTSXTVSKQAEVSSVPDHLTSXXRPDVRXSPSFSQNCLXYKNDKQMSYGFXXPPYLSSSPEXKYDXXLXTNXXPXYPXFKRXXNYXQRXXXKKYXSERNGXNXISGPXXDYDYDGLHDTEDKIKQYXEGSSXPXPTHXXSXXTSCLDFTQPADKCDGPLSVSSFXXPHRPDNEESCNSSEDESKWXEELXKMXTXRXRDXEHXTSXDXFRKTSRSYPEXXTXKTYLHTYESEI

SEQ ID NO: 687 - protein, 747 aa, Homo sapiens
  SITE (250)..(250): Xaa at position 250 is Ala, Gly, or Pro
  SITE (254)..(254): Xaa at position 254 is Leu, Ala, Val, Gly, or Ile
  SITE (266)..(266): Xaa at position 266 is Ala, Gly, or Pro
  SITE (269)..(269): Xaa at position 269 is Ile, Ala, Val, Leu, or Gly
  SITE (273)..(273): Xaa at position 273 is Cys, Ala, Val, Gly, Ser, or Thr
  SITE (279)..(279): Xaa at position 279 is Ala, Gly, or Pro
  SITE (283)..(283): Xaa at position 283 is Val, Ala, Gly, Leu, or Ile
  SITE (292)..(292): Xaa at position 292 is Leu, Ala, Val, Gly, or Ile
  SITE (293)..(293): Xaa at position 293 is Val, Ala, Gly, Leu, or Ile
  SITE (303)..(303): Xaa at position 303 is Val, Ala, Gly, Leu, or Ile
  SITE (306)..(306): Xaa at position 306 is Ala, Gly, or Pro
  SITE (307)..(307): Xaa at position 307 is Ala, Gly, or Pro
  SITE (308)..(308): Xaa at position 308 is Ala, Gly, or Pro
  SITE (310)..(310): Xaa at position 310 is Ala, Gly, or Pro
  SITE (311)..(311): Xaa at position 311 is Leu, Ala, Val, Gly, or Ile
  SITE (314)..(314): Xaa at position 314 is Leu, Ala, Val, Gly, or Ile
  SITE (315)..(315): Xaa at position 315 is Val, Ala, Gly, Leu, or Ile
  SITE (338)..(338): Xaa at position 338 is Leu, Ala, Val, Gly, or Ile
  SITE (346)..(346): Xaa at position 346 is Ile, Ala, Val, Leu, or Gly
  SITE (350)..(350): Xaa at position 350 is Leu, Ala, Val, Gly, or Ile
  SITE (354)..(354): Xaa at position 354 is Leu, Ala, Val, Gly, or Ile
  SITE (367)..(367): Xaa at position 367 is Leu, Ala, Val, Gly, or Ile
  SITE (371)..(371): Xaa at position 371 is Ala, Gly, or Pro
  SITE (372)..(372): Xaa at position 372 is Leu, Ala, Val, Gly, or Ile
  SITE (375)..(375): Xaa at position 375 is Leu, Ala, Val, Gly, or Ile
  SITE (376)..(376): Xaa at position 376 is Ala, Gly, or Pro
  SITE (379)..(379): Xaa at position 379 is Val, Ala, Gly, Leu, or Ile
  SITE (380)..(380): Xaa at position 380 is Ile, Ala, Val, Leu, or Gly
  SITE (402)..(402): Xaa at position 402 is Val, Ala, Gly, Leu, or Ile
  SITE (403)..(403): Xaa at position 403 is Phe, Tyr, Met, His, Ile, Leu, Val Ala, or Gly
  SITE (406)..(406): Xaa at position 406 is Ala, Gly, or Pro
  SITE (409)..(409): Xaa at position 409 is Cys, Ala, Val, Gly, Ser, or Thr
  SITE (410)..(410): Xaa at position 410 is Leu, Ala, Val, Gly, or Ile
  SITE (434)..(434): Xaa at position 434 is Leu, Ala, Val, Gly, or Ile
  SITE (444)..(444): Xaa at position 444 is Met, Ile, Leu, Val, Ala, or Gly
  SITE (450)..(450): Xaa at position 450 is Leu, Ala, Val, Gly, or Ile
  SITE (451)..(451): Xaa at position 451 is Ile, Ala, Val, Leu, or Gly
  SITE (454)..(454): Xaa at position 454 is Leu, Ala, Val, Gly, or Ile
  SITE (455)..(455): Xaa at position 455 is Met, Ile, Leu, Val, Ala, or Gly
  SITE (458)..(458): Xaa at position 458 is Val, Ala, Gly, Leu, or Ile
  SITE (472)..(472): Xaa at position 472 is Val, Ala, Gly, Leu, or Ile
  SITE (475)..(475): Xaa at position 475 is Cys, Ala, Val, Gly, Ser, or Thr
  SITE (476)..(476): Xaa at position 476 is Met, Ile, Leu, Val, Ala, or Gly
  SITE (478)..(478): Xaa at position 478 is Val, Ala, Gly, Leu, or Ile
  SITE (479)..(479): Xaa at position 479 is Leu, Ala, Val, Gly, or Ile
  SITE (482)..(482): Xaa at position 482 is Leu, Ala, Val, Gly, or Ile
  SITE (486)..(486): Xaa at position 486 is Leu, Ala, Val, Gly, or Ile
  SITE (543)..(543): Xaa at position 543 is Leu, Ala, Val, Gly, or Ile
  SITE (548)..(548): Xaa at position 548 is Ala, Gly, or Pro
  SITE (549)..(549): Xaa at position 549 is Ile, Ala, Val, Leu, or Gly
  SITE (552)..(552): Xaa at position 552 is Tyr, Phe, Met, His, Ile, Leu, Val Ala, or Gly
  SITE (555)..(555): Xaa at position 555 is Leu, Ala, Val, Gly, or Ile
  SITE (567)..(567): Xaa at position 567 is Ala, Gly, or Pro
  SITE (568)..(568): Xaa at position 568 is Cys, Ala, Val, Gly, Ser, or Thr
  SITE (569)..(569): Xaa at position 569 is Ala, Gly, or Pro
  SITE (571)..(571): Xaa at position 571 is Ala, Gly, or Pro
  SITE (572)..(572): Xaa at position 572 is Leu, Ala, Val, Gly, or Ile
  SITE (575)..(575): Xaa at position 575 is Leu, Ala, Val, Gly, or Ile
  SITE (582)..(582): Xaa at position 582 is Met, Ile, Leu, Val, Ala, or Gly
  SITE (586)..(586): Xaa at position 586 is Met, Ile, Leu, Val, Ala, or Gly
  SITE (590)..(590): Xaa at position 590 is Ile, Ala, Val, Leu, or Gly
  SITE (597)..(597): Xaa at position 597 is Leu, Ala, Val, Gly, or Ile
  SITE (600)..(600): Xaa at position 600 is Ile, Ala, Val, Leu, or Gly
  SITE (611)..(611): Xaa at position 611 is Val, Ala, Gly, Leu, or Ile
  SITE (616)..(616): Xaa at position 616 is Ala, Gly, or Pro
  SITE (618)..(618): Xaa at position 618 is Leu, Ala, Val, Gly, or Ile
  SITE (619)..(619): Xaa at position 619 is Leu, Ala, Val, Gly, or Ile
  SITE (622)..(622): Xaa at position 622 is Met, Ile, Leu, Val, Ala, or Gly
  SITE (628)..(628): Xaa at position 628 is Leu, Ala, Val, Gly, or Ile
  SITE (632)..(632): Xaa at position 632 is Met, Ile, Leu, Val, Ala, or Gly
  SITE (636)..(636): Xaa at position 636 is Val, Ala, Gly, Leu, or Ile
  SITE (637)..(637): Xaa at position 637 is Phe, Tyr, Met, His, Ile, Leu, Val Ala, or Gly
  SITE (657)..(657): Xaa at position 657 is Ile, Ala, Val, Leu, or Gly
  SITE (661)..(661): Xaa at position 661 is Ala, Gly, or Pro
  SITE (665)..(665): Xaa at position 665 is Val, Ala, Gly, Leu, or Ile
  SITE (668)..(668): Xaa at position 668 is Leu, Ala, Val, Gly, or Ile
  SITE (670)..(670): Xaa at position 670 is Ala, Gly, or Pro
  SITE (700)..(700): Xaa at position 700 is Ala, Gly, or Pro
  SITE (704)..(704): Xaa at position 704 is Ala, Gly, or Pro
MNHSPLKTALAYECFQDQDNSTLALPSDQKMKTGTSGRQRVQEQVMMTVKRQKSKSSQSSTLSHSNRGSMYDGLADNYNYGTTSRSSYYSKFQAGNGSWGYPIYNGTLKREPDNRRFSSYSQMENWSRHYPRGSCNTTGAGSDICFMQKIKASRSEPDLYCDPRGTLRKGTLGSKGQKTTQNRYSFYSTCSGQKAIKKCPVRPPSCASKQDPVYIPPISCNKDLSFGHSRASSKICSEDIECSGLTIPKXVQYXSSQDEKYQAIGXYYXQHTXFQDESXKQQXYQLGGICKXXDLLRSPNQNXQQXXXGXXRNXXFRSTTNKLETRRQNGIREAVSLXRRTGNAEXQKQXTGLXWNLSSTDELKEEXIADXXPVXXDRXXIPFSGWCDGNSNMSREVVDPEXXFNXTGXXRKRLGMRELLALVPQRATSSRVNXSSADAGRQTXRNYSGXXDSXXAYXQNCVAASRCDDKSXENXXCXXHNXSYRXDAEVPTRYRQLEYNARNAYTEKSSTGCFSNKSDKMMNNNYDCPLPEEETNPKGSGWXYHSDXXRTXLNXMGKSKKDATLEXXXGXXQNXTASKGLXSSGXSQLXGLKEKGXPQXARLLQSGNSDXVRSGXSXXSNXSRHPLXHRVXGNQXXPEVTRLLTSHTGNTSNSEDXLSSXCYTXRNXMXSQPQLAKQYFSSSMLNNIINLCRSSASPKXAEAXRLLLSDMWSSKELQGVLRQQGFDRNMLGTLAGANSLRNFTSRF

SEQ ID NO: 688 - protein, 1038 aa, Homo sapiens
  SITE (492)..(492): Xaa at position 492 is Leu, Ala, Val, Gly, or Ile
MTSSLQRPWRVPWLPWTILLVSTAAASQNQERLCAFKDPYQQDLGIGESRISHENGTILCSKGSTCYGLWEKSKGDINLVKQGCWSHIGDPQECHYEECVVTTTPPSIQNGTYRFCCCSTDLCNVNFTENFPPPDTTPLSPPHSFNRDETIIIALASVSVLAVLIVALCFGYRMLTGDRKQGLHSMNMMEAAASEPSLDLDNLKLLELIGRGRYGAVYKGSLDERPVAVKVFSFANRQNFINEKNIYRVPLMEHDNIARFIVGDERVTADGRMEYLLVMEYYPNGSLCKYLSLHTSDWVSSCRLAHSVTRGLAYLHTELPRGDHYKPAISHRDLNSRNVLVKNDGTCVISDFGLSMRLTGNRLVRPGEEDNAAISEVGTIRYMAPEVLEGAVNLRDCESALKQVDMYALGLIYWEIFMRCTDLFPGESVPEYQMAFQTEVGNHPTFEDMQVLVSREKQRPKFPEAWKENSLAVRSLKETIEDCWDQDAEARXTAQCAEERMAELMMIWERNKSVSPTVNPMSTAMQNERNLSHNRRVPKIGPYPDYSSSSYIEDSIHHTDSIVKNISSEHSMSSTPLTIGEKNRNSINYERQQAQARIPSPETSVTSLSTNTTTTNTTGLTPSTGMTTISEMPYPDETNLHTTNVAQSIGPTPVCLQLTEEDLETNKLDPKEVDKNLKESSDENLMEHSLKQFSGPDPLSSTSSSLLYPLIKLAVEATGQQDFTQTANGQACLIPDVLPTQIYPLPKQQNLPKRPTSLPLNTKNSTKEPRLKFGSKHKSNLKQVETGVAKMNTINAAEPHVVTVTMNGVAGRNHSVNSHAATTQYANGTVLSGQTTNIVTHRAQEMLQNQFIGEDTRLNINSSPDEHEPLLRREQQAGHDEGVLDRLVDRRERPLEGGRTNSNNNNSNPCSEQDVLAQGVPSTAADPGPSKPRRAQRPNSLDLSATNVLDGSSIQIGESTQDGKSGSGEKIKKRVKTPYSLKRWRPSTWVISTESLDCEVNNNGSNRAVHSKSSTAVYLAEGGTATTMVSKDIGMNCL

SEQ ID NO: 689 - protein, 2221 aa, Homo sapiens
  SITE (702)..(702): Xaa at position 702 is Ile, Ala, Val, Leu, or Gly
  SITE (1131)..(1131): Xaa at position 1131 is Val, Ala, Gly, Leu, or Ile
  SITE (1453)..(1453): Xaa at position 1453 is Ala, Gly, or Pro
  SITE (1470)..(1470): Xaa at position 1470 is Met, Ile, Leu, Val, Ala, or Gly
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWVNDAVGRDWPWIYFVTLIIIGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQXLTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILFYFDIVFTTIFTIEIALKILGNADYVFTSIFTLEIILKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTXSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKGYFSDPWNVFDFLIVIGSIIDVILSETNHYFCDAWNTFDALIVVGSIVDIAITEVNPAEHTQCSPSMNAEENSRISITFFRLFRVMRLVKLLSRGEGIRTLLWTFIKSFQALPYVALLIVMLFFIYAVIGMQVFGKIALNDTTEINRNNNFQTFPQXVLLLFRCATGEAWQDIXLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRERHVPMCEDLELRRDSGSAGTQAHCLLLRKANPSRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 690 - protein, 142 aa, Homo sapiens
  SITE (10)..(10): Xaa at position 10 is Cys, Ala, Val, Gly, Ser, or Thr
  SITE (12)..(12): Xaa at position 12 is Ala, Gly, or Pro
  SITE (13)..(13): Xaa at position 13 is Ala, Gly, or Pro
  SITE (14)..(14): Xaa at position 14 is Tyr, Phe, Met, His, Ile, Leu, Val Ala, or Gly
  SITE (17)..(17): Xaa at position 17 is Val, Ala, Gly, Leu, or Ile
  SITE (26)..(26): Xaa at position 26 is Trp, Tyr, Phe, Met, His, Ile, Leu Val, Ala, or Gly
  SITE (27)..(27): Xaa at position 27 is Val, Ala, Gly, Leu, or Ile
  SITE (29)..(29): Xaa at position 29 is Phe, Tyr, Met, His, Ile, Leu, Val Ala, or Gly
  SITE (36)..(36): Xaa at position 36 is Ile, Ala, Val, Leu, or Gly
  SITE (48)..(48): Xaa at position 48 is Phe, Tyr, Met, His, Ile, Leu, Val Ala, or Gly
  SITE (52)..(52): Xaa at position 52 is Cys, Ala, Val, Gly, Ser, or Thr
  SITE (58)..(58): Xaa at position 58 is Leu, Ala, Val, Gly, or Ile
  SITE (59)..(59): Xaa at position 59 is Phe, Tyr, Met, His, Ile, Leu, Val Ala, or Gly
  SITE (60)..(60): Xaa at position 60 is Ala, Gly, or Pro
  SITE (61)..(61): Xaa at position 61 is Phe, Tyr, Met, His, Ile, Leu, Val Ala, or Gly
  SITE (62)..(62): Xaa at position 62 is Val, Ala, Gly, Leu, or Ile
  SITE (64)..(64): Xaa at position 64 is Phe, Tyr, Met, His, Ile, Leu, Val Ala, or Gly
  SITE (77)..(77): Xaa at position 77 is Ala, Gly, or Pro
  SITE (78)..(78): Xaa at position 78 is Leu, Ala, Val, Gly, or Ile
  SITE (79)..(79): Xaa at position 79 is Ile, Ala, Val, Leu, or Gly
  SITE (81)..(81): Xaa at position 81 is Trp, Tyr, Phe, Met, His, Ile, Leu Val, Ala, or Gly
  SITE (82)..(82): Xaa at position 82 is Ile, Ala, Val, Leu, or Gly
  SITE (101)..(101): Xaa at position 101 is Val, Ala, Gly, Leu, or Ile
  SITE (104)..(104): Xaa at position 104 is Val, Ala, Gly, Leu, or Ile
  SITE (105)..(105): Xaa at position 105 is Val, Ala, Gly, Leu, or Ile
  SITE (114)..(114): Xaa at position 114 is Ile, Ala, Val, Leu, or Gly
  SITE (120)..(120): Xaa at position 120 is Leu, Ala, Val, Gly, or Ile
  SITE (125)..(125): Xaa at position 125 is Ile, Ala, Val, Leu, or Gly
  SITE (129)..(129): Xaa at position 129 is Leu, Ala, Val, Gly, or Ile
MATKIDKEAXRXXXNLXRDDGSAVIXXTXKYDGSTXVPGEQGAEYQHXIQQXTDDVRXXXXXRXTTGDAMSKRSKFXXXTXXGENVSGLQRAKTGTDKTLXKEXXQNFAKEFVXSDRKEXEEDFXKSEXKKAGGANYDAQTE

SEQ ID NO: 691 - protein, 355 aa, Homo sapiens
  SITE (99)..(99): Xaa at position 99 is Met, Ile, Leu, Val, Ala, or Gly
  SITE (101)..(101): Xaa at position 101 is Ile, Ala, Val, Leu, or Gly
  SITE (104)..(104): Xaa at position 104 is Leu, Ala, Val, Gly, or Ile
  SITE (113)..(113): Xaa at position 113 is Leu, Ala, Val, Gly, or Ile
  SITE (117)..(117): Xaa at position 117 is Phe, Tyr, Met, His, Ile, Leu, Val Ala, or Gly
  SITE (130)..(130): Xaa at position 130 is Leu, Ala, Val, Gly, or Ile
  SITE (143)..(143): Xaa at position 143 is Val, Ala, Gly, Leu, or Ile
  SITE (154)..(154): Xaa at position 154 is Val, Ala, Gly, Leu, or Ile
  SITE (160)..(160): Xaa at position 160 is His, Phe, Tyr, Lys, Arg, Gly, Ser Thr, Ala, Val, Leu, Ile, Asn, Met, or Gln
  SITE (167)..(167): Xaa at position 167 is Ile, Ala, Val, Leu, or Gly
  SITE (184)..(184): Xaa at position 184 is Ile, Ala, Val, Leu, or Gly
  SITE (186)..(186): Xaa at position 186 is Val, Ala, Gly, Leu, or Ile
  SITE (198)..(198): Xaa at position 198 is Ile, Ala, Val, Leu, or Gly
  SITE (202)..(202): Xaa at position 202 is Phe, Tyr, Met, His, Ile, Leu, Val Ala, or Gly
  SITE (226)..(226): Xaa at position 226 is Cys, Ala, Val, Gly, Ser, or Thr
  SITE (228)..(228): Xaa at position 228 is Ile, Ala, Val, Leu, or Gly
  SITE (230)..(230): Xaa at position 230 is Phe, Tyr, Met, His, Ile, Leu, Val Ala, or Gly
  SITE (236)..(236): Xaa at position 236 is Val, Ala, Gly, Leu, or Ile
  SITE (239)..(239): Xaa at position 239 is Ile, Ala, Val, Leu, or Gly
  SITE (245)..(245): Xaa at position 245 is His, Phe, Tyr, Lys, Arg, Gly, Ser Thr, Ala, Val, Leu, Ile, Asn, Met, or Gln
  SITE (247)..(247): Xaa at position 247 is Val, Ala, Gly, Leu, or Ile
  SITE (254)..(254): Xaa at position 254 is Ile, Ala, Val, Leu, or Gly
MSEEQFGGDGAAAAATAAVGGSAGEQEGAMVAATQGAAAAAGSGAGTGGGTASGGTEGGSAESEGAKIDASKNEEDEGHSNSSPRHSEAATAQREEWKXFXGGXSWDTTKKDXKDYXSKFGEVVDCTLKXDPITGRSRGFGFXLFKESESVDKXMDQKEXKLNGKVXDPKRAKAMKTKEPVKKXFXGGLSPDTPEEKXREYXGGFGEVESIELPMDNKTNKRRGFXFXTXKEEEPXKKXMEKKYXNXGLSKCEXKVAMSKEQYQQQQQWGSRGGFAGRARGRGGGPSQNWNQGYSNYWNQGYGNYGYNSQGYGGYGGYDYTGYNNYYGYGDYSNQQSGYGKVSRRGGHQNSYKPY

SEQ ID NO: 692 - protein, 478 aa, Homo sapiens
  SITE (42)..(42): Xaa at position 42 is Val, Ala, Gly, Leu, or Ile
  SITE (43)..(43): Xaa at position 43 is Leu, Ala, Val, Gly, or Ile
  SITE (64)..(64): Xaa at position 64 is Phe, Tyr, Met, His, Ile, Leu, Val Ala, or Gly
  SITE (66)..(66): Xaa at position 66 is Phe, Tyr, Met, His, Ile, Leu, Val Ala, or Gly
  SITE (67)..(67): Xaa at position 67 is Phe, Tyr, Met, His, Ile, Leu, Val Ala, or Gly
  SITE (69)..(69): Xaa at position 69 is Val, Ala, Gly, Leu, or Ile
  SITE (75)..(75): Xaa at position 75 is Ile, Ala, Val, Leu, or Gly
  SITE (89)..(89): Xaa at position 89 is Tyr, Phe, Met, His, Ile, Leu, Val Ala, or Gly
  SITE (102)..(102): Xaa at position 102 is Phe, Tyr, Met, His, Ile, Leu, Val Ala, or Gly
  SITE (109)..(109): Xaa at position 109 is Ile, Ala, Val, Leu, or Gly
  SITE (111)..(111): Xaa at position 111 is Ala, Gly, or Pro
  SITE (133)..(133): Xaa at position 133 is Ile, Ala, Val, Leu, or Gly
  SITE (136)..(136): Xaa at position 136 is Leu, Ala, Val, Gly, or Ile
  SITE (138)..(138): Xaa at position 138 is Ile, Ala, Val, Leu, or Gly
  SITE (140)..(140): Xaa at position 140 is Val, Ala, Gly, Leu, or Ile
  SITE (143)..(143): Xaa at position 143 is Val, Ala, Gly, Leu, or Ile
  SITE (156)..(156): Xaa at position 156 is Ile, Ala, Val, Leu, or Gly
  SITE (160)..(160): Xaa at position 160 is Leu, Ala, Val, Gly, or Ile
  SITE (167)..(167): Xaa at position 167 is Leu, Ala, Val, Gly, or Ile
  SITE (173)..(173): Xaa at position 173 is Val, Ala, Gly, Leu, or Ile
  SITE (177)..(177): Xaa at position 177 is Leu, Ala, Val, Gly, or Ile
  SITE (184)..(184): Xaa at position 184 is Ile, Ala, Val, Leu, or Gly
  SITE (188)..(188): Xaa at position 188 is Ile, Ala, Val, Leu, or Gly
  SITE (201)..(201): Xaa at position 201 is Leu, Ala, Val, Gly, or Ile
  SITE (213)..(213): Xaa at position 213 is Tyr, Phe, Met, His, Ile, Leu, Val Ala, or Gly
  SITE (228)..(228): Xaa at position 228 is Ile, Ala, Val, Leu, or Gly
  SITE (245)..(245): Xaa at position 245 is Cys, Ala, Val, Gly, Ser, or Thr
  SITE (256)..(256): Xaa at position 256 is Phe, Tyr, Met, His, Ile, Leu, Val Ala, or Gly
  SITE (269)..(269): Xaa at position 269 is Phe, Tyr, Met, His, Ile, Leu, Val Ala, or Gly
  SITE (273)..(273): Xaa at position 273 is Phe, Tyr, Met, His, Ile, Leu, Val Ala, or Gly
  SITE (274)..(274): Xaa at position 274 is Cys, Ala, Val, Gly, Ser, or Thr
  SITE (287)..(287): Xaa at position 287 is Val, Ala, Gly, Leu, or Ile
  SITE (292)..(292): Xaa at position 292 is Ala, Gly, or Pro
  SITE (293)..(293): Xaa at position 293 is Phe, Tyr, Met, His, Ile, Leu, Val Ala, or Gly
  SITE (295)..(295): Xaa at position 295 is Tyr, Phe, Met, His, Ile, Leu, Val Ala, or Gly
  SITE (299)..(299): Xaa at position 299 is Ala, Gly, or Pro
  SITE (301)..(301): Xaa at position 301 is Ile, Ala, Val, Leu, or Gly
  SITE (302)..(302): Xaa at position 302 is Leu, Ala, Val, Gly, or Ile
  SITE (323)..(323): Xaa at position 323 is Val, Ala, Gly, Leu, or Ile
  SITE (326)..(326): Xaa at position 326 is Val, Ala, Gly, Leu, or Ile
  SITE (337)..(337): Xaa at position 337 is Met, Ile, Leu, Val, Ala, or Gly
  SITE (342)..(342): Xaa at position 342 is Phe, Tyr, Met, His, Ile, Leu, Val Ala, or Gly
  SITE (349)..(349): Xaa at position 349 is Phe, Tyr, Met, His, Ile, Leu, Val Ala, or Gly
  SITE (350)..(350): Xaa at position 350 is Val, Ala, Gly, Leu, or Ile
  SITE (353)..(353): Xaa at position 353 is Ile, Ala, Val, Leu, or Gly
  SITE (369)..(369): Xaa at position 369 is Ile, Ala, Val, Leu, or Gly
  SITE (376)..(376): Xaa at position 376 is Ile, Ala, Val, Leu, or Gly
  SITE (377)..(377): Xaa at position 377 is Leu, Ala, Val, Gly, or Ile
  SITE (379)..(379): Xaa at position 379 is Ala, Gly, or Pro
  SITE (387)..(387): Xaa at position 387 is Ile, Ala, Val, Leu, or Gly
  SITE (389)..(389): Xaa at position 389 is Val, Ala, Gly, Leu, or Ile
  SITE (395)..(395): Xaa at position 395 is Phe, Tyr, Met, His, Ile, Leu, Val Ala, or Gly
  SITE (396)..(396): Xaa at position 396 is Val, Ala, Gly, Leu, or Ile
  SITE (406)..(406): Xaa at position 406 is Phe, Tyr, Met, His, Ile, Leu, Val Ala, or Gly
  SITE (408)..(408): Xaa at position 408 is Val, Ala, Gly, Leu, or Ile
  SITE (409)..(409): Xaa at position 409 is Met, Ile, Leu, Val, Ala, or Gly
  SITE (415)..(415): Xaa at position 415 is Val, Ala, Gly, Leu, or Ile
  SITE (422)..(422): Xaa at position 422 is Ala, Gly, or Pro
MGRCCFYTAGTLSLLLLVTSVTLLVARVFQKAVDQSIEKKIXXRNGTEAFDSWEKPPLPVYTQXYXXNXTNPEEXLRGETPRVEEVGPXTYRELRNKANIQXGDNGTTXSXVSNKAYVFERDQSVGDPKIDLXRTXNXPXLTXIEWSQVHFLREIXEAMXKAYQQKXFVTHTXDELXWGYKDEXLSLXHVFRPDISPYFGXFYEKNGTNDGDXVFLTGEDSYLNFTKXVEWNGKTSLDWWITDKXNMINGTDGDSXHPLITKDEVLYVXPSDXXRSVYITFSDYESXQGLPXXRXKVPXEXXANTSDNAGFCIPEGNCLGSGXLNXSICKNGAPIIXSFPHXYQADERXXSAXEGMHPNQEDHETFVDXNPLTGIXXKXAKRFQINXYXKKLDDXXETGDIRTMVXPXXYLNESXHIDKETXSRLKSMINTTLIITNIPYIIMALGVFFGLVFTWLACKGQGSMDEGTADERAPLIRT

SEQ ID NO: 693 - protein, 963 aa, Homo sapiens
  SITE (52)..(52): Xaa at position 52 is Phe, Tyr, Met, His, Ile, Leu, Val Ala, or Gly
  SITE (54)..(54): Xaa at position 54 is Cys, Ala, Val, Gly, Ser, or Thr
  SITE (72)..(72): Xaa at position 72 is Cys, Ala, Val, Gly, Ser, or Thr
  SITE (93)..(93): Xaa at position 93 is Cys, Ala, Val, Gly, Ser, or Thr
  SITE (97)..(97): Xaa at position 97 is His, Phe, Tyr, Lys, Arg, Gly, Ser Thr, Ala, Val, Leu, Ile, Asn, Met, or Gln
  SITE (99)..(99): Xaa at position 99 is Ile, Ala, Val, Leu, or Gly
  SITE (111)..(111): Xaa at position 111 is Cys, Ala, Val, Gly, Ser, or Thr
  SITE (134)..(134): Xaa at position 134 is Cys, Ala, Val, Gly, Ser, or Thr
  SITE (142)..(142): Xaa at position 142 is Val, Ala, Gly, Leu, or Ile
  SITE (154)..(154): Xaa at position 154 is Cys, Ala, Val, Gly, Ser, or Thr
  SITE (158)..(158): Xaa at position 158 is Ala, Gly, or Pro
  SITE (172)..(172): Xaa at position 172 is Phe, Tyr, Met, His, Ile, Leu, Val Ala, or Gly
  SITE (174)..(174): Xaa at position 174 is Cys, Ala, Val, Gly, Ser, or Thr
  SITE (180)..(180): Xaa at position 180 is Leu, Ala, Val, Gly, or Ile
  SITE (192)..(192): Xaa at position 192 is Cys, Ala, Val, Gly, Ser, or Thr
  SITE (211)..(211): Xaa at position 211 is Phe, Tyr, Met, His, Ile, Leu, Val Ala, or Gly
  SITE (213)..(213): Xaa at position 213 is Cys, Ala, Val, Gly, Ser, or Thr
  SITE (220)..(220): Xaa at position 220 is Ala, Gly, or Pro
  SITE (234)..(234): Xaa at position 234 is Cys, Ala, Val, Gly, Ser, or Thr
  SITE (285)..(285): Xaa at position 285 is Cys, Ala, Val, Gly, Ser, or Thr
  SITE (340)..(340): Xaa at position 340 is Cys, Ala, Val, Gly, Ser, or Thr
  SITE (350)..(350): Xaa at position 350 is Ile, Ala, Val, Leu, or Gly
  SITE (351)..(351): Xaa at position 351 is Cys, Ala, Val, Gly, Ser, or Thr
  SITE (362)..(362): Xaa at position 362 is Cys, Ala, Val, Gly, Ser, or Thr
  SITE (374)..(374): Xaa at position 374 is Cys, Ala, Val, Gly, Ser, or Thr
  SITE (424)..(424): Xaa at position 424 is Leu, Ala, Val, Gly, or Ile
  SITE (426)..(426): Xaa at position 426 is Phe, Tyr, Met, His, Ile, Leu, Val Ala, or Gly
  SITE (435)..(435): Xaa at position 435 is Ile, Ala, Val, Leu, or Gly
  SITE (437)..(437): Xaa at position 437 is Leu, Ala, Val, Gly, or Ile
  SITE (446)..(446): Xaa at position 446 is Ile, Ala, Val, Leu, or Gly
  SITE (454)..(454): Xaa at position 454 is Ala, Gly, or Pro
  SITE (503)..(503): Xaa at position 503 is Ala, Gly, or Pro
  SITE (512)..(512): Xaa at position 512 is Tyr, Phe, Met, His, Ile, Leu, Val Ala, or Gly
  SITE (570)..(570): Xaa at position 570 is Leu, Ala, Val, Gly, or Ile
  SITE (601)..(601): Xaa at position 601 is Val, Ala, Gly, Leu, or Ile
  SITE (634)..(634): Xaa at position 634 is Ile, Ala, Val, Leu, or Gly
  SITE (635)..(635): Xaa at position 635 is Ala, Gly, or Pro
  SITE (651)..(651): Xaa at position 651 is Ile, Ala, Val, Leu, or Gly
  SITE (700)..(700): Xaa at position 700 is Cys, Ala, Val, Gly, Ser, or Thr
MGLPEPGPLRLLALLLLLLLLLLLQLQHLAAAAADPLLGGQGPAKDCEKDQXQXRNERCIPSVWRCDEDDDXLDHSDEDDCPKKTCADSDFTXDNGXCXHERWKCDGEEEXPDGSDESEATCTKQVCPAEKLSXGPTSHKCXPASWRCDGEKDXEGGXDEAGCATLCAPHEXQXGNRSCXAAVFVCDGDDDXGDGSDERGCADPACGPREXRXGGDGGGXCIPERWVCDRQFDXEDRSDEAAELCGRPGPGATSAPAACATASQFACRSGECVHLGWRCDGDRDXKDKSDEADCPLGTCRGDEFQCGDGTCVLAIKHCNQEQDCPDGSDEAGCLQGLNEXLHNNGGCSHXXTDLKIGFECTXPAGFQLLDQKTXGDIDECKDPDACSQICVNYKGYFKCECYPGYEMDLLTKNCKAAAGKSPSXIXTNRHEVRRXDXVKRNYSRLXPMLKNVVXLDVEVATNRIYWCDLSYRKIYSAYMDKASDPKEQEVLIDEQLHSPEGLXVDWVHKHIXWTDSGNKTISVATVDGGRRRTLFSRNLSEPRAIAVDPLRGFMYWSDWGDQAKIEKSGXNGVDRQTLVSDNIEWPNGITLDLLSQRLYWXDSKLHQLSSIDFSGGNRKTLISSTDFLSHPFGXXVFEDKVFWTDLENEAXFSANRLNGLEISILAENLNNPHDIVIFHELKQPRAPDACELSVQPNGGXEYLCLPAPQISSHSPKYTCACPDTMWLGPDMKRCYRAPQSTSTTTLASTMTRTVPATTRAPGTTVHRSTYQNHSTETPSLTAAVPSSVSVPRAPSISPSTLSPATSNHSQHYANEDSKMGSTVTAAVIGIIVPIVVIALLCMSGYLIWRNWKRKNTKSMNFDNPVYRKTTEEEDEDELHIGRTAQIGHVYPAAISSFDRPLWAEPCLGETREPEDPAPALKELFVLPGEPRSQLHQLPKNPLSELPVVKSKRVALSLEDDGLP

SEQ ID NO: 694 - protein, 519 aa, Homo sapiens
  SITE (7)..(7): Xaa at position 7 is Leu, Ala, Val, Gly, or Ile
  SITE (8)..(8): Xaa at position 8 is Leu, Ala, Val, Gly, or Ile
  SITE (9)..(9): Xaa at position 9 is Ile, Ala, Val, Leu, or Gly
  SITE (14)..(14): Xaa at position 14 is Val, Ala, Gly, Leu, or Ile
  SITE (15)..(15): Xaa at position 15 is Val, Ala, Gly, Leu, or Ile
  SITE (23)..(23): Xaa at position 23 is Ala, Gly, or Pro
  SITE (25)..(25): Xaa at position 25 is Val, Ala, Gly, Leu, or Ile
  SITE (27)..(27): Xaa at position 27 is Val, Ala, Gly, Leu, or Ile
  SITE (32)..(32): Xaa at position 32 is Val, Ala, Gly, Leu, or Ile
  SITE (35)..(35): Xaa at position 35 is Leu, Ala, Val, Gly, or Ile
  SITE (54)..(54): Xaa at position 54 is Ala, Gly, or Pro
  SITE (59)..(59): Xaa at position 59 is Val, Ala, Gly, Leu, or Ile
  SITE (60)..(60): Xaa at position 60 is Leu, Ala, Val, Gly, or Ile
  SITE (64)..(64): Xaa at position 64 is Ile, Ala, Val, Leu, or Gly
  SITE (67)..(67): Xaa at position 67 is His, Phe, Tyr, Lys, Arg, Gly, Ser Thr, Ala, Val, Leu, Ile, Asn, Met, or Gln
  SITE (69)..(69): Xaa at position 69 is His, Phe, Tyr, Lys, Arg, Gly, Ser Thr, Ala, Val, Leu, Ile, Asn, Met, or Gln
  SITE (70)..(70): Xaa at position 70 is Met, Ile, Leu, Val, Ala, or Gly
  SITE (75)..(75): Xaa at position 75 is Met, Ile, Leu, Val, Ala, or Gly
  SITE (80)..(80): Xaa at position 80 is Ile, Ala, Val, Leu, or Gly
  SITE (83)..(83): Xaa at position 83 is Phe, Tyr, Met, His, Ile, Leu, Val Ala, or Gly
  SITE (89)..(89): Xaa at position 89 is Ala, Gly, or Pro
  SITE (90)..(90): Xaa at position 90 is Ala, Gly, or Pro
  SITE (91)..(91): Xaa at position 91 is Leu, Ala, Val, Gly, or Ile
  SITE (97)..(97): Xaa at position 97 is Met, Ile, Leu, Val, Ala, or Gly
  SITE (98)..(98): Xaa at position 98 is Ile, Ala, Val, Leu, or Gly
  SITE (99)..(99): Xaa at position 99 is Ile, Ala, Val, Leu, or Gly
  SITE (101)..(101): Xaa at position 101 is Phe, Tyr, Met, His, Ile, Leu, Val Ala, or Gly
  SITE (102)..(102): Xaa at position 102 is Ala, Gly, or Pro
  SITE (110)..(110): Xaa at position 110 is Leu, Ala, Val, Gly, or Ile
  SITE (111)..(111): Xaa at position 111 is Ile, Ala, Val, Leu, or Gly
  SITE (113)..(113): Xaa at position 113 is Ala, Gly, or Pro
  SITE (117)..(117): Xaa at position 117 is Trp, Tyr, Phe, Met, His, Ile, Leu Val, Ala, or Gly
  SITE (121)..(121): Xaa at position 121 is Ala, Gly, or Pro
  SITE (125)..(125): Xaa at position 125 is Val, Ala, Gly, Leu, or Ile
  SITE (126)..(126): Xaa at position 126 is Cys, Ala, Val, Gly, Ser, or Thr
  SITE (127)..(127): Xaa at position 127 is Cys, Ala, Val, Gly, Ser, or Thr
  SITE (129)..(129): Xaa at position 129 is Tyr, Phe, Met, His, Ile, Leu, Val Ala, or Gly
  SITE (131)..(131): Xaa at position 131 is Leu, Ala, Val, Gly, or Ile
  SITE (132)..(132): Xaa at position 132 is His, Phe, Tyr, Lys, Arg, Gly, Ser Thr, Ala, Val, Leu, Ile, Asn, Met, or Gln
  SITE (133)..(133): Xaa at position 133 is Val, Ala, Gly, Leu, or Ile
  SITE (134)..(134): Xaa at position 134 is Ala, Gly, or Pro
  SITE (135)..(135): Xaa at position 135 is Val, Ala, Gly, Leu, or Ile
  SITE (142)..(142): Xaa at position 142 is Val, Ala, Gly, Leu, or Ile
  SITE (146)..(146): Xaa at position 146 is Met, Ile, Leu, Val, Ala, or Gly
  SITE (149)..(149): Xaa at position 149 is Leu, Ala, Val, Gly, or Ile
  SITE (150)..(150): Xaa at position 150 is Val, Ala, Gly, Leu, or Ile
  SITE (155)..(155): Xaa at position 155 is Val, Ala, Gly, Leu, or Ile
  SITE (158)..(158): Xaa at position 158 is Phe, Tyr, Met, His, Ile, Leu, Val Ala, or Gly
  SITE (160)..(160): Xaa at position 160 is Met, Ile, Leu, Val, Ala, or Gly
  SITE (162)..(162): Xaa at position 162 is Met, Ile, Leu, Val, Ala, or Gly
  SITE (163)..(163): Xaa at position 163 is Ala, Gly, or Pro
  SITE (168)..(168): Xaa at position 168 is Tyr, Phe, Met, His, Ile, Leu, Val Ala, or Gly
  SITE (170)..(170): Xaa at position 170 is Val, Ala, Gly, Leu, or Ile
  SITE (175)..(175): Xaa at position 175 is Leu, Ala, Val, Gly, or Ile
  SITE (178)..(178): Xaa at position 178 is Ala, Gly, or Pro
  SITE (179)..(179): Xaa at position 179 is Phe, Tyr, Met, His, Ile, Leu, Val Ala, or Gly
  SITE (182)..(182): Xaa at position 182 is Cys, Ala, Val, Gly, Ser, or Thr
  SITE (185)..(185): Xaa at position 185 is Ile, Ala, Val, Leu, or Gly
  SITE (187)..(187): Xaa at position 187 is Ala, Gly, or Pro
  SITE (188)..(188): Xaa at position 188 is Ile, Ala, Val, Leu, or Gly
  SITE (189)..(189): Xaa at position 189 is Ala, Gly, or Pro
  SITE (191)..(191): Xaa at position 191 is Val, Ala, Gly, Leu, or Ile
  SITE (192)..(192): Xaa at position 192 is His, Phe, Tyr, Lys, Arg, Gly, Ser Thr, Ala, Val, Leu, Ile, Asn, Met, or Gln
  SITE (193)..(193): Xaa at position 193 is Ala, Gly, or Pro
  SITE (217)..(217): Xaa at position 217 is His, Phe, Tyr, Lys, Arg, Gly, Ser Thr, Ala, Val, Leu, Ile, Asn, Met, or Gln
  SITE (229)..(229): Xaa at position 229 is Ala, Gly, or Pro
  SITE (233)..(233): Xaa at position 233 is Ala, Gly, or Pro
  SITE (234)..(234): Xaa at position 234 is Ile, Ala, Val, Leu, or Gly
  SITE (236)..(236): Xaa at position 236 is Ile, Ala, Val, Leu, or Gly
  SITE (237)..(237): Xaa at position 237 is Ala, Gly, or Pro
  SITE (244)..(244): Xaa at position 244 is Leu, Ala, Val, Gly, or Ile
  SITE (245)..(245): Xaa at position 245 is Tyr, Phe, Met, His, Ile, Leu, Val Ala, or Gly
  SITE (246)..(246): Xaa at position 246 is Ile, Ala, Val, Leu, or Gly
  SITE (247)..(247): Xaa at position 247 is Val, Ala, Gly, Leu, or Ile
  SITE (248)..(248): Xaa at position 248 is His, Phe, Tyr, Lys, Arg, Gly, Ser Thr, Ala, Val, Leu, Ile, Asn, Met, or Gln
  SITE (249)..(249): Xaa at position 249 is Val, Ala, Gly, Leu, or Ile
  SITE (250)..(250): Xaa at position 250 is Met, Ile, Leu, Val, Ala, or Gly
  SITE (254)..(254): Xaa at position 254 is Ala, Gly, or Pro
  SITE (255)..(255): Xaa at position 255 is Ala, Gly, or Pro
  SITE (258)..(258): Xaa at position 258 is Ile, Ala, Val, Leu, or Gly
  SITE (261)..(261): Xaa at position 261 is Ala, Gly, or Pro
  SITE (268)..(268): Xaa at position 268 is Val, Ala, Gly, Leu, or Ile
  SITE (273)..(273): Xaa at position 273 is Ile, Ala, Val, Leu, or Gly
  SITE (274)..(274): Xaa at position 274 is Ala, Gly, or Pro
  SITE (275)..(275): Xaa at position 275 is Ala, Gly, or Pro
  SITE (277)..(277): Xaa at position 277 is Leu, Ala, Val, Gly, or Ile
  SITE (284)..(284): Xaa at position 284 is Tyr, Phe, Met, His, Ile, Leu, Val Ala, or Gly
  SITE (292)..(292): Xaa at position 292 is Ala, Gly, or Pro
  SITE (293)..(293): Xaa at position 293 is Ala, Gly, or Pro
  SITE (295)..(295): Xaa at position 295 is His, Phe, Tyr, Lys, Arg, Gly, Ser Thr, Ala, Val, Leu, Ile, Asn, Met, or Gln
  SITE (296)..(296): Xaa at position 296 is Val, Ala, Gly, Leu, or Ile
  SITE (297)..(297): Xaa at position 297 is Met, Ile, Leu, Val, Ala, or Gly
  SITE (301)..(301): Xaa at position 301 is Leu, Ala, Val, Gly, or Ile
  SITE (311)..(311): Xaa at position 311 is Leu, Ala, Val, Gly, or Ile
  SITE (312)..(312): Xaa at position 312 is Met, Ile, Leu, Val, Ala, or Gly
  SITE (314)..(314): Xaa at position 314 is Leu, Ala, Val, Gly, or Ile
  SITE (315)..(315): Xaa at position 315 is Leu, Ala, Val, Gly, or Ile
  SITE (320)..(320): Xaa at position 320 is Leu, Ala, Val, Gly, or Ile
  SITE (328)..(328): Xaa at position 328 is Cys, Ala, Val, Gly, Ser, or Thr
  SITE (330)..(330): Xaa at position 330 is Phe, Tyr, Met, His, Ile, Leu, Val Ala, or Gly
  SITE (342)..(342): Xaa at position 342 is Phe, Tyr, Met, His, Ile, Leu, Val Ala, or Gly
  SITE (345)..(345): Xaa at position 345 is Ile, Ala, Val, Leu, or Gly
  SITE (349)..(349): Xaa at position 349 is Val, Ala, Gly, Leu, or Ile
  SITE (352)..(352): Xaa at position 352 is Val, Ala, Gly, Leu, or Ile
  SITE (356)..(356): Xaa at position 356 is Met, Ile, Leu, Val, Ala, or Gly
  SITE (358)..(358): Xaa at position 358 is Val, Ala, Gly, Leu, or Ile
  SITE (359)..(359): Xaa at position 359 is Ile, Ala, Val, Leu, or Gly
  SITE (360)..(360): Xaa at position 360 is Trp, Tyr, Phe, Met, His, Ile, Leu Val, Ala, or Gly
  SITE (364)..(364): Xaa at position 364 is Val, Ala, Gly, Leu, or Ile
  SITE (374)..(374): Xaa at position 374 is Phe, Tyr, Met, His, Ile, Leu, Val Ala, or Gly
  SITE (375)..(375): Xaa at position 375 is Val, Ala, Gly, Leu, or Ile
  SITE (377)..(377): Xaa at position 377 is Val, Ala, Gly, Leu, or Ile
  SITE (382)..(382): Xaa at position 382 is Ala, Gly, or Pro
  SITE (383)..(383): Xaa at position 383 is Ala, Gly, or Pro
  SITE (385)..(385): Xaa at position 385 is Ile, Ala, Val, Leu, or Gly
  SITE (386)..(386): Xaa at position 386 is Phe, Tyr, Met, His, Ile, Leu, Val Ala, or Gly
  SITE (395)..(395): Xaa at position 395 is Ile, Ala, Val, Leu, or Gly
  SITE (401)..(401): Xaa at position 401 is Ala, Gly, or Pro
  SITE (403)..(403): Xaa at position 403 is Ile, Ala, Val, Leu, or Gly
  SITE (404)..(404): Xaa at position 404 is Val, Ala, Gly, Leu, or Ile
  SITE (405)..(405): Xaa at position 405 is Ile, Ala, Val, Leu, or Gly
  SITE (406)..(406): Xaa at position 406 is Trp, Tyr, Phe, Met, His, Ile, Leu Val, Ala, or Gly
  SITE (414)..(414): Xaa at position 414 is Ile, Ala, Val, Leu, or Gly
  SITE (423)..(423): Xaa at position 423 is Val, Ala, Gly, Leu, or Ile
  SITE (428)..(428): Xaa at position 428 is Phe, Tyr, Met, His, Ile, Leu, Val Ala, or Gly
  SITE (433)..(433): Xaa at position 433 is Cys, Ala, Val, Gly, Ser, or Thr
  SITE (439)..(439): Xaa at position 439 is Val, Ala, Gly, Leu, or Ile
  SITE (441)..(441): Xaa at position 441 is Ile, Ala, Val, Leu, or Gly
  SITE (447)..(447): Xaa at position 447 is Val, Ala, Gly, Leu, or Ile
  SITE (462)..(462): Xaa at position 462 is Phe, Tyr, Met, His, Ile, Leu, Val Ala, or Gly
  SITE (463)..(463): Xaa at position 463 is Ile, Ala, Val, Leu, or Gly
  SITE (469)..(469): Xaa at position 469 is Ala, Gly, or Pro
  SITE (472)..(472): Xaa at position 472 is Ile, Ala, Val, Leu, or Gly
  SITE (473)..(473): Xaa at position 473 is Tyr, Phe, Met, His, Ile, Leu, Val Ala, or Gly
  SITE (476)..(476): Xaa at position 476 is Ile, Ala, Val, Leu, or Gly
MAAPSRXXXRGGRXXNDDFSEVXDXLXEDGVXRAXGHDLLPPGGAPAGLRVLDXAGKLXXPGGXDTXTXXQFPFXGSRSXDDXHQGTKXXXSGGTTXXXDXXIPQKGGSXXEXFETXRSWXDPKXXXDXSXXXXXTWWSDQXKEEXKIXXQDKGXNSXKXFXXYKDLXMXTDLEXYEXXSRXKEXGXXXQXXXENGDLIAEGAKKMLALGITGPEGXELCRPEAVEAEXTLRXXTXXSAVNCPXXXXXXXSKSXXKVXADXRRDGKVXYGEPXXXSXGTDGTHXWNKEWHHXXHXXXGPPXRPDPSTPDFXXNXXANDDXTTTGTDNXTXNTCQKALGKDDXTKXPNGXNGXEDRXSXXXEKGXHSGKMDENRXXAXTSTNXXKXXNLYPRKGRXAVGSDXDXXXXDPKGTRTXSAKTHHQAXNFNIXEGMVXHGVPLXTXSRGKVXYEAGVFSVTAGDGKXXPRKPFXEYXXKRXKQRDRTCTPTPVERAPYKGEVATLKSRVTKEDATAGTRKQAHP

SEQ ID NO: 695 - protein, 1118 aa, Homo sapiens
  SITE (58)..(58): Xaa at position 58 is Leu, Ala, Val, Gly, or Ile
  SITE (64)..(64): Xaa at position 64 is Leu, Ala, Val, Gly, or Ile
  SITE (85)..(85): Xaa at position 85 is Ile, Ala, Val, Leu, or Gly
  SITE (87)..(87): Xaa at position 87 is Tyr, Phe, Met, His, Ile, Leu, Val Ala, or Gly
  SITE (101)..(101): Xaa at position 101 is Ile, Ala, Val, Leu, or Gly
  SITE (102)..(102): Xaa at position 102 is Phe, Tyr, Met, His, Ile, Leu, Val Ala, or Gly
  SITE (111)..(111): Xaa at position 111 is Leu, Ala, Val, Gly, or Ile
  SITE (113)..(113): Xaa at position 113 is Val, Ala, Gly, Leu, or Ile
  SITE (117)..(117): Xaa at position 117 is Leu, Ala, Val, Gly, or Ile
  SITE (125)..(125): Xaa at position 125 is Phe, Tyr, Met, His, Ile, Leu, Val Ala, or Gly
  SITE (127)..(127): Xaa at position 127 is Leu, Ala, Val, Gly, or Ile
  SITE (131)..(131): Xaa at position 131 is Ala, Gly, or Pro
  SITE (145)..(145): Xaa at position 145 is Leu, Ala, Val, Gly, or Ile
  SITE (147)..(147): Xaa at position 147 is Ile, Ala, Val, Leu, or Gly
  SITE (181)..(181): Xaa at position 181 is Ile, Ala, Val, Leu, or Gly
  SITE (210)..(210): Xaa at position 210 is Val, Ala, Gly, Leu, or Ile
  SITE (220)..(220): Xaa at position 220 is Ile, Ala, Val, Leu, or Gly
  SITE (227)..(227): Xaa at position 227 is Leu, Ala, Val, Gly, or Ile
  SITE (237)..(237): Xaa at position 237 is Leu, Ala, Val, Gly, or Ile
  SITE (239)..(239): Xaa at position 239 is Val, Ala, Gly, Leu, or Ile
  SITE (241)..(241): Xaa at position 241 is Ala, Gly, or Pro
  SITE (256)..(256): Xaa at position 256 is Ala, Gly, or Pro
  SITE (258)..(258): Xaa at position 258 is Val, Ala, Gly, Leu, or Ile
  SITE (260)..(260): Xaa at position 260 is Ile, Ala, Val, Leu, or Gly
  SITE (293)..(293): Xaa at position 293 is Ile, Ala, Val, Leu, or Gly
  SITE (295)..(295): Xaa at position 295 is Val, Ala, Gly, Leu, or Ile
  SITE (308)..(308): Xaa at position 308 is Ala, Gly, or Pro
  SITE (334)..(334): Xaa at position 334 is Val, Ala, Gly, Leu, or Ile
  SITE (336)..(336): Xaa at position 336 is Leu, Ala, Val, Gly, or Ile
  SITE (340)..(340): Xaa at position 340 is Val, Ala, Gly, Leu, or Ile
  SITE (352)..(352): Xaa at position 352 is Val, Ala, Gly, Leu, or Ile
  SITE (375)..(375): Xaa at position 375 is Ile, Ala, Val, Leu, or Gly
  SITE (377)..(377): Xaa at position 377 is Val, Ala, Gly, Leu, or Ile
  SITE (413)..(413): Xaa at position 413 is Phe, Tyr, Met, His, Ile, Leu, Val Ala, or Gly
  SITE (415)..(415): Xaa at position 415 is Ala, Gly, or Pro
  SITE (428)..(428): Xaa at position 428 is Tyr, Phe, Met, His, Ile, Leu, Val Ala, or Gly
  SITE (437)..(437): Xaa at position 437 is Trp, Tyr, Phe, Met, His, Ile, Leu Val, Ala, or Gly
  SITE (438)..(438): Xaa at position 438 is Ile, Ala, Val, Leu, or Gly
  SITE (447)..(447): Xaa at position 447 is Ile, Ala, Val, Leu, or Gly
  SITE (465)..(465): Xaa at position 465 is Tyr, Phe, Met, His, Ile, Leu, Val Ala, or Gly
  SITE (467)..(467): Xaa at position 467 is Val, Ala, Gly, Leu, or Ile
  SITE (469)..(469): Xaa at position 469 is Ile, Ala, Val, Leu, or Gly
  SITE (471)..(471): Xaa at position 471 is Ala, Gly, or Pro
  SITE (485)..(485): Xaa at position 485 is Val, Ala, Gly, Leu, or Ile
  SITE (487)..(487): Xaa at position 487 is Ile, Ala, Val, Leu, or Gly
  SITE (515)..(515): Xaa at position 515 is Val, Ala, Gly, Leu, or Ile
  SITE (544)..(544): Xaa at position 544 is Trp, Tyr, Phe, Met, His, Ile, Leu Val, Ala, or Gly
  SITE (554)..(554): Xaa at position 554 is Val, Ala, Gly, Leu, or Ile
  SITE (556)..(556): Xaa at position 556 is Leu, Ala, Val, Gly, or Ile
  SITE (568)..(568): Xaa at position 568 is Ile, Ala, Val, Leu, or Gly
  SITE (570)..(570): Xaa at position 570 is Phe, Tyr, Met, His, Ile, Leu, Val Ala, or Gly
  SITE (572)..(572): Xaa at position 572 is Ile, Ala, Val, Leu, or Gly
  SITE (586)..(586): Xaa at position 586 is Leu, Ala, Val, Gly, or Ile
  SITE (588)..(588): Xaa at position 588 is Leu, Ala, Val, Gly, or Ile
MARSPGRAYALLLLLICFNVGSGLHLQVLSTRNENKLLPKHPHLVRQKRAWITAPVAXREGEDXSKKNPIAKIHSDLAEERGLKXTXKYTGKGITEPPFGXXVFNKDTGEXNXTSIXDREETPFXLXTGYXLDARGNNVEKPLEXRXKVLDINDNEPVFTQDVFVGSVEELSAAHTLVMKXNATDADEPNTLNSKISYRIVSLEPAYPPXFYLNKDTGEXYTTSVTXDREEHSSYTXTXEXRDGNGEVTDKPVKQXQXQXRILDVNDNIPVVENKVLEGMVEENQVNVEVTRXKXFDADEIGSDNWLXNFTFASGNEGGYFHIETDAQTNEGIXTXIKEXDYEEMKNLDFSXIVANKAAFHKSIRSKYKPTPIPXKXKVKNVKEGIHFKSSVISIYVSESMDRSSKGQIIGNXQXFDEDTGLPAHARXVKLEDRDNXXSVDSVTSEXKLAKLPDFESRYVQNGTXTXKXVXISEDYPRKTITGTXLXNVEDINDNCPTLIEPVQTICHDAEYVNXTAEDLDGHPNSGPFSFSVIDKPPGMAEKXKIARQESTSXLXQQSEKKLGRSEXQXLXSDNQGFSCPEKQVXTXTVCECLHGSGCREAQHDSYVGLGPAAIALMILAFLLLLLVPLLLLMCHCGKGAKGFTPIPGTIEMLHPWNNEGAPPEDKVVPSFLPVDQGGSLVGRNGVGGMAKEATMKGSSSASIVKGQHEMSEMDGRWEEHRSLLSGRATQFTGATGAIMTTETTKTARATGASRDMAGAQAAAVALNEEFLRNYFTDKAASYTEEDENHTAKDCLLVYSQEETESLNASIGCCSFIEGELDDRFLDDLGLKFKTLAEVCLGQKIDINKEIEQRQKPATETSMNTASHSLCEQTMVNSENTYSSGSSFPVPKSLQEANAEKVTQEIVTERSVSSRQAQKVATPLPDPMASRNVIATETSYVTGSTMPPTTVILGPSQPQSLIVTERVYAPASTLVDQPYANEGTVVVTERVIQPHGGGSNPLEGTQHLQDVPYVMVRERESFLAPSSGVQPTLAMPNIAVGQNVTVTERVLAPASTLQSSYQIPTENSMTARNTTVSGAGVPGPLPDFGLEESGHSNSTITTSSTRVTKHSTVQHSYS

SEQ ID NO: 696 - protein, 4646 aa, Homo sapiens
  SITE (2837)..(2837): Xaa at position 2837 is Leu, Ala, Val, Gly, or Ile
  SITE (2838)..(2838): Xaa at position 2838 is Val, Ala, Gly, Leu, or Ile
  SITE (2953)..(2953): Xaa at position 2953 is Met, Ile, Leu, Val, Ala, or Gly
  SITE (2956)..(2956): Xaa at position 2956 is Leu, Ala, Val, Gly, or Ile
  SITE (2993)..(2993): Xaa at position 2993 is Ile, Ala, Val, Leu, or Gly
  SITE (3115)..(3115): Xaa at position 3115 is Leu, Ala, Val, Gly, or Ile
  SITE (3352)..(3352): Xaa at position 3352 is Val, Ala, Gly, Leu, or Ile
  SITE (3472)..(3472): Xaa at position 3472 is Val, Ala, Gly, Leu, or Ile
  SITE (3645)..(3645): Xaa at position 3645 is Leu, Ala, Val, Gly, or Ile
  SITE (3669)..(3669): Xaa at position 3669 is Ile, Ala, Val, Leu, or Gly
  SITE (3780)..(3780): Xaa at position 3780 is Val, Ala, Gly, Leu, or Ile
  SITE (3790)..(3790): Xaa at position 3790 is Val, Ala, Gly, Leu, or Ile
  SITE (3811)..(3811): Xaa at position 3811 is Ile, Ala, Val, Leu, or Gly
  SITE (3856)..(3856): Xaa at position 3856 is Leu, Ala, Val, Gly, or Ile
  SITE (3947)..(3947): Xaa at position 3947 is Leu, Ala, Val, Gly, or Ile
  SITE (4031)..(4031): Xaa at position 4031 is Val, Ala, Gly, Leu, or Ile
  SITE (4158)..(4158): Xaa at position 4158 is Leu, Ala, Val, Gly, or Ile
  SITE (4331)..(4331): Xaa at position 4331 is Leu, Ala, Val, Gly, or Ile
  SITE (4482)..(4482): Xaa at position 4482 is Phe, Tyr, Met, His, Ile, Leu Val, Ala, or Gly
  SITE (4514)..(4514): Xaa at position 4514 is Leu, Ala, Val, Gly, or Ile
MSEPGGGGGEDGSAGLEVSAVQNVADVSVLQKHLRKLVPLLLEDGGEAPAALEAALEEKSALEQMRKFLSDPQVHTVLVERSTLKEDVGDEGEEEKEFISYNINIDIHYGVKSNSLAFIKRTPVIDADKPVSSQLRVLTLSEDSPYETLHSFISNAVAPFFKSYIRESGKADRDGDKMAPSVEKKIAELEMGLLHLQQNIEIPEISLPIHPMITNVAKQCYERGEKPKVTDFGDKVEDPTFLNQLQSGVNRWIREIQKVTKLDRDPASGTALQEISFWLNLERALYRIQEKRESPEVLLTLDILKHGKRFHATVSFDTDTGLKQALETVNDYNPLMKDFPLNDLLSATELDKIRQALVAIFTHLRKIRNTKYPIQRALRLVEAISRDLSSQLLKVLGTRKLMHVAYEEFEKVMVACFEVFQTWDDEYEKLQVLLRDIVKRKREENLKMVWRINPAHRKLQARLDQMRKFRRQHEQLRAVIVRVLRPQVTAVAQQNQGEVPEPQDMKVAEVLFDAADANAIEEVNLAYENVKEVDGLDVSKEGTEAWEAAMKRYDERIDRVETRITARLRDQLGTAKNANEMFRIFSRFNALFVRPHIRGAIREYQTQLIQRVKDDIESLHDKFKVQYPQSQACKMSHVRDLPPVSGSIIWAKQIDRQLTAYMKRVEDVLGKGWENHVEGQKLKQDGDSFRMKLNTQEIFDDWARKVQQRNLGVSGRIFTIESTRVRGRTGNVLKLKVNFLPEIITLSKEVRNLKWLGFRVPLAIVNKAHQANQLYPFAISLIESVRTYERTCEKVEERNTISLLVAGLKKEVQALIAEGIALVWESYKLDPYVQRLAETVFNFQEKVDDLLIIEEKIDLEVRSLETCMYDHKTFSEILNRVQKAVDDLNLHSYSNLPIWVNKLDMEIERILGVRLQAGLRAWTQVLLGQAEDKAEVDMDTDAPQVSHKPGGEPKIKNVVHELRITNQVIYLNPPIEECRYKLYQEMFAWKMVVLSLPRIQSQRYQVGVHYELTEEEKFYRNALTRMPDGPVALEESYSAVMGIVSEVEQYVKVWLQYQCLWDMQAENIYNRLGEDLNKWQALLVQIRKARGTFDNAETKKEFGPVVIDYGKVQSKVNLKYDSWHKEVLSKFGQMLGSNMTEFHSQISKSRQELEQHSVDTASTSDAVTFITYVQSLKRKIKQFEKQVELYRNGQRLLEKQRFQFPPSWLYIDNIEGEWGAFNDIMRRKDSAIQQQVANLQMKIVQEDRAVESRTTDLLTDWEKTKPVTGNLRPEEALQALTIYEGKFGRLKDDREKCAKAKEALELTDTGLLSGSEERVQVALEELQDLKGVWSELSKVWEQIDQMKEQPWVSVQPRKLRQNLDALLNQLKSFPARLRQYASYEFVQRLLKGYMKINMLVIELKSEALKDRHWKQLMKRLHVNWVVSELTLGQIWDVDLQKNEAIVKDVLLVAQGEMALEEFLKQIREVWNTYELDLVNYQNKCRLIRGWDDLFNKVKEHINSVSAMKLSPYYKVFEEDALSWEDKLNRIMALFDVWIDVQRRWVYLEGIFTGSADIKHLLPVETQRFQSISTEFLALMKKVSKSPLVMDVLNIQGVQRSLERLADLLGKIQKALGEYLERERSSFPRFYFVGDEDLLEIIGNSKNVAKLQKHFKKMFAGVSSIILNEDNSVVLGISSREGEEVMFKTPVSITEHPKINEWLTLVEKEMRVTLAKLLAESVTEVEIFGKATSIDPNTYITWIDKYQAQLVVLSAQIAWSENVETALSSMGGGGDAAPLHSVLSNVEVTLNVLADSVLMEQPPLRRRKLEHLITELVHQRDVTRSLIKSKIDNAKSFEWLSQMRFYFDPKQTDVLQQLSIQMANAKFNYGFEYLGVQDKLVQTPLTDRCYLTMTQALEARLGGSPFGPAGTGKTESVKALGHQLGRFVLVFNCDETFDFQAMGRIFVGLCQVGAWGCFDEFNRLEERMLSAVSQQVQCIQEALREHSNPNYDKTSAPITCELLNKQVKVSPDMAIFITMNPGYAGRSNLPDNLKKLFRSLAMTKPDRQLIAQVMLYSQGFRTAEVLANKIVPFFKLCDEQLSSQSHYDFGLRALKSVLVSAGNVKRERIQKIKREKEERGEAVDEGEIAENLPEQEILIQSVCETMVPKLVAEDIPLLFSLLSDVFPGVQYHRGEMTALREELKKVCQEMYLTYGDGEEVGGMWVEKVLQLYQITQINHGLMMVGPSGSGKSMAWRVLLKALERLEGVEGVAHIIDPKAISKDHLYGTLDPNTREWTDGLFTHVLRKIIDSVRGELQKRQWIVFDGDVDPEWVENLNSVLDDNKLLTLPNGERLSLPPNVRIMFEVQDLKYATLATVSRCGMVWFSEDVLSTDMIFNNFLARLRSIPLDEGEDEAQRRRKGKEDEGEEAASPMLQIQRDAATIMQPYFTSNGLVTKALEHAFQLEHIMDLTRLRCLGSLFSMLHQACRNVAQYNANHPDFPMQIEQLERYIQRYLVYAILWSLSGDSRLKMRAELGEYIRRITTVPLPTAPNIPIIDYEVSISGEWSPWQAKVPQIEVETHKVAAPDVVVPTLDTVRHEALLYTWLAEHKPLVLCGPPGSGKTMTLFSALRALPDMEVVGLNFSSATTPELLLKTFDHYCEYRRTPNGVVLAPVQLGKWLVLFCDEINLPDMDKYGTQRVISFIRQMVEHGGFYRTSDQTWVKLERIQFVGACNPPTDPGRKPLSHRFLRHVPVVYVDYPGPASLTQIYGTFNRAMLRLIPSLRTYAEPLTAAMVEFYTMSQERFTQDTQPHYIYSPREMTRWVRGIFEALRPLETLPVEGLIRIWAHEALRLFQDRXXEDEERRWTDENIDTVALKHFPNIDREKAMSRPILYSNWLSKDYIPVDQEELRDYVKARLKVFYEEELDVPLVLFNEVLDHVLRIDRIFRQPQGHLLLIGVSGAGKTTLSRFVAWXNGXSVYQIKVHRKYTGEDFDEDLRTVLRRSGCKNEKIAFXMDESNVLDSGFLERMNTLLANGEVPGLFEGDEYATLMTQCKEGAQKEGLMLDSHEELYKWFTSQVIRNLHVVFTMNPSSEGLKDRAATSPALFNRCVLNWFGDWSTEALYQVGKEFTSKMDXEKPNYIVPDYMPVVYDKLPQPPSHREAIVNSCVFVHQTLHQANARLAKRGGRTMAITPRHYLDFINHYANLFHEKRSELEEQQMHLNVGLRKIKETVDQVEELRRDLRIKSQELEVKNAAANDKLKKMVKDQQEAEKKKVMSQEIQEQLHKQQEVIADKQMSVKEDLDKVEPAVIEAQNAVKSIKKQHLVEVRSMANPPAAVKLALESICLLLGESTTDWKQIRSIIMRENFIPTIXNFSAEEISDAIREKMKKNYMSNPSYNYEIVNRASLACGPMVKWAIAQLNYADMLKRVEPLRNELQKLEDDAKDNQQKANEVEQMIRDLEASIARYKEEYAVLISEAQAIKADLAAVEAKXNRSTALLKSLSAERERWEKTSETFKNQMSTIAGDCLLSAAFIAYAGYFDQQMRQNLFTTWSHHLQQANIQFRTDIARTEYLSNADERLRWQASSLPADDLCTENAIMLKRFNRYPLIIDPSGQATEFIMNEYKDRKITRTSFLDDAFRKNLESALRFGNPLLVQDVESYDPVXNPVLNREVRRTGGRVLITLGDQDXDLSPSFVIFLSTRDPTVEFPPDLCSRVTFVNFTVTRSSLQSQCLNEVLKAERPDVDEKRSDLLKLQGEFQLRLRQLEKSLLQALNEVKGRILDDDTIITTLENLKREAAEXTRKVEETDIXMQEVETVSQQYLPLSTACSSXYFTMESLKQIHFLYQYSLQFFLDIYHNVLYENPNLKGVTDHTQRXSIITKDLFQVAFNRVARGMLHQDHITFAMLLARIKLKGTVGEPTYDAEFQHFLRGNEIVLSAGSTPRIQGLTVEQAEAVVRLSCLPAFKDXIAKVQADEQFGIWLDSSSPEQTVPYLWSEETPATPIGQAIHRLLLIQAFRPDRLLAMAHMFVSTNLGESFMSIMEQPLDLTHIXGTEVKPNTPVLMCSVPGYDASGHVEDLAAEQNTQITSIAIGSAEGFNQADKAINTAVKSGRWVMLKNVHLAPGWLMQLEKKLHSLQPHACFRLFLTMEINPKVPVNLLRAGRIFVFEPPPGVKANMXRTFSSIPVSRICKSPNERARLYFLLAWFHAIIQERLRYAPLGWSKKYEFGESDLRSACDTVDTWLDDTAKGRQNISPDKIPWSALKTLMAQSIYGGRVDNEFDQRLLNTFLERLFTTRSFDSEFKLACKVDGHKDIQMPDGIRREEFVQWVELLPDTQTPSWLGLPNNAERVXLTTQGVDMISKMLKMQMLEDEDDLAYAETEKKTRTDSTSDGRPAWMRTLHTTASNWLHLIPQTLSHLKRTVENIKDPLFRFFEREVKMGAKLLQDVRQDLADVVQVCEGKKKQTNYLRTLINELVKGILPRSWSHYTVPAGMTVIQWVSDXSERIKQLQNISLAAASGGAKELKNIHVCLGGXFVPEAYITATRQYVAQANSWSLEELCLEVNVTTSQGATLDACSFGVTGLKLQGATCNNNKLSLSNAISTALPLTQLRWVKQTNTEKKASVVTLPVYLNFTRADLIFTVDFEIATKEDPRSFYERGVAVLCTE

SEQ ID NO: 697 - protein, 2725 aa, Homo sapiens
  SITE (42)..(42): Xaa at position 42 is Phe, Tyr, Met, His, Ile, Leu, Val Ala, or Gly
  SITE (46)..(46): Xaa at position 46 is Cys, Ala, Val, Gly, Ser, or Thr
  SITE (50)..(50): Xaa at position 50 is Leu, Ala, Val, Gly, or Ile
  SITE (57)..(57): Xaa at position 57 is Leu, Ala, Val, Gly, or Ile
  SITE (60)..(60): Xaa at position 60 is Leu, Ala, Val, Gly, or Ile
  SITE (64)..(64): Xaa at position 64 is Leu, Ala, Val, Gly, or Ile
  SITE (70)..(70): Xaa at position 70 is Leu, Ala, Val, Gly, or Ile
  SITE (71)..(71): Xaa at position 71 is Ile, Ala, Val, Leu, or Gly
  SITE (73)..(73): Xaa at position 73 is Leu, Ala, Val, Gly, or Ile
  SITE (74)..(74): Xaa at position 74 is Leu, Ala, Val, Gly, or Ile
  SITE (100)..(100): Xaa at position 100 is Val, Ala, Gly, Leu, or Ile
  SITE (102)..(102): Xaa at position 102 is Val, Ala, Gly, Leu, or Ile
  SITE (103)..(103): Xaa at position 103 is Ala, Gly, or Pro
  SITE (104)..(104): Xaa at position 104 is Leu, Ala, Val, Gly, or Ile
  SITE (106)..(106): Xaa at position 106 is Phe, Tyr, Met, His, Ile, Leu, Val Ala, or Gly
  SITE (107)..(107): Xaa at position 107 is Leu, Ala, Val, Gly, or Ile
  SITE (122)..(122): Xaa at position 122 is Ile, Ala, Val, Leu, or Gly
  SITE (130)..(130): Xaa at position 130 is Ile, Ala, Val, Leu, or Gly
  SITE (131)..(131): Xaa at position 131 is Leu, Ala, Val, Gly, or Ile
  SITE (133)..(133): Xaa at position 133 is Leu, Ala, Val, Gly, or Ile
  SITE (134)..(134): Xaa at position 134 is Ile, Ala, Val, Leu, or Gly
  SITE (137)..(137): Xaa at position 137 is Leu, Ala, Val, Gly, or Ile
  SITE (138)..(138): Xaa at position 138 is Ile, Ala, Val, Leu, or Gly
  SITE (143)..(143): Xaa at position 143 is Ile, Ala, Val, Leu, or Gly
  SITE (165)..(165): Xaa at position 165 is Leu, Ala, Val, Gly, or Ile
  SITE (169)..(169): Xaa at position 169 is Ile, Ala, Val, Leu, or Gly
  SITE (173)..(173): Xaa at position 173 is Val, Ala, Gly, Leu, or Ile
  SITE (181)..(181): Xaa at position 181 is Phe, Tyr, Met, His, Ile, Leu, Val Ala, or Gly
  SITE (185)..(185): Xaa at position 185 is Trp, Tyr, Phe, Met, His, Ile, Leu Val, Ala, or Gly
  SITE (190)..(190): Xaa at position 190 is Ala, Gly, or Pro
  SITE (191)..(191): Xaa at position 191 is Leu, Ala, Val, Gly, or Ile
  SITE (193)..(193): Xaa at position 193 is Ala, Gly, or Pro
  SITE (194)..(194): Xaa at position 194 is Leu, Ala, Val, Gly, or Ile
  SITE (195)..(195): Xaa at position 195 is Val, Ala, Gly, Leu, or Ile
  SITE (199)..(199): Xaa at position 199 is Ala, Gly, or Pro
  SITE (203)..(203): Xaa at position 203 is Cys, Ala, Val, Gly, Ser, or Thr
  SITE (218)..(218): Xaa at position 218 is Ala, Gly, or Pro
  SITE (221)..(221): Xaa at position 221 is Ala, Gly, or Pro
  SITE (222)..(222): Xaa at position 222 is Met, Ile, Leu, Val, Ala, or Gly
  SITE (225)..(225): Xaa at position 225 is Ala, Gly, or Pro
  SITE (229)..(229): Xaa at position 229 is Leu, Ala, Val, Gly, or Ile
  SITE (231)..(231): Xaa at position 231 is Val, Ala, Gly, Leu, or Ile
  SITE (234)..(234): Xaa at position 234 is Val, Ala, Gly, Leu, or Ile
  SITE (235)..(235): Xaa at position 235 is Ile, Ala, Val, Leu, or Gly
  SITE (240)..(240): Xaa at position 240 is Ile, Ala, Val, Leu, or Gly
  SITE (250)..(250): Xaa at position 250 is Val, Ala, Gly, Leu, or Ile
  SITE (251)..(251): Xaa at position 251 is Met, Ile, Leu, Val, Ala, or Gly
  SITE (253)..(253): Xaa at position 253 is Tyr, Phe, Met, His, Ile, Leu, Val Ala, or Gly
  SITE (254)..(254): Xaa at position 254 is Leu, Ala, Val, Gly, or Ile
  SITE (278)..(278): Xaa at position 278 is Ala, Gly, or Pro
  SITE (296)..(296): Xaa at position 296 is Ala, Gly, or Pro
  SITE (300)..(300): Xaa at position 300 is Val, Ala, Gly, Leu, or Ile
  SITE (305)..(305): Xaa at position 305 is Ala, Gly, or Pro
  SITE (312)..(312): Xaa at position 312 is Val, Ala, Gly, Leu, or Ile
  SITE (338)..(338): Xaa at position 338 is Val, Ala, Gly, Leu, or Ile
  SITE (348)..(348): Xaa at position 348 is His, Phe, Tyr, Lys, Arg, Gly, Ser Thr, Ala, Val, Leu, Ile, Asn, Met, or Gln
  SITE (350)..(350): Xaa at position 350 is Val, Ala, Gly, Leu, or Ile
  SITE (352)..(352): Xaa at position 352 is Val, Ala, Gly, Leu, or Ile
  SITE (354)..(354): Xaa at position 354 is Phe, Tyr, Met, His, Ile, Leu, Val Ala, or Gly
  SITE (359)..(359): Xaa at position 359 is Ile, Ala, Val, Leu, or Gly
  SITE (366)..(366): Xaa at position 366 is Val, Ala, Gly, Leu, or Ile
  SITE (590)..(590): Xaa at position 590 is Ala, Gly, or Pro
  SITE (592)..(592): Xaa at position 592 is Phe, Tyr, Met, His, Ile, Leu, Val Ala, or Gly
  SITE (593)..(593): Xaa at position 593 is Val, Ala, Gly, Leu, or Ile
  SITE (594)..(594): Xaa at position 594 is Val, Ala, Gly, Leu, or Ile
  SITE (626)..(626): Xaa at position 626 is Cys, Ala, Val, Gly, Ser, or Thr
  SITE (628)..(628): Xaa at position 628 is Val, Ala, Gly, Leu, or Ile
  SITE (630)..(630): Xaa at position 630 is Tyr, Phe, Met, His, Ile, Leu, Val Ala, or Gly
  SITE (638)..(638): Xaa at position 638 is Tyr, Phe, Met, His, Ile, Leu, Val Ala, or Gly
  SITE (640)..(640): Xaa at position 640 is Val, Ala, Gly, Leu, or Ile
  SITE (642)..(642): Xaa at position 642 is Val, Ala, Gly, Leu, or Ile
  SITE (656)..(656): Xaa at position 656 is Ala, Gly, or Pro
  SITE (665)..(665): Xaa at position 665 is Cys, Ala, Val, Gly, Ser, or Thr
  SITE (688)..(688): Xaa at position 688 is Ala, Gly, or Pro
  SITE (692)..(692): Xaa at position 692 is Ile, Ala, Val, Leu, or Gly
  SITE (697)..(697): Xaa at position 697 is Ala, Gly, or Pro
  SITE (728)..(728): Xaa at position 728 is Cys, Ala, Val, Gly, Ser, or Thr
  SITE (740)..(740): Xaa at position 740 is Ile, Ala, Val, Leu, or Gly
  SITE (741)..(741): Xaa at position 741 is Ile, Ala, Val, Leu, or Gly
  SITE (742)..(742): Xaa at position 742 is Ile, Ala, Val, Leu, or Gly
  SITE (756)..(756): Xaa at position 756 is Val, Ala, Gly, Leu, or Ile
  SITE (758)..(758): Xaa at position 758 is Val, Ala, Gly, Leu, or Ile
  SITE (1065)..(1065): Xaa at position 1065 is Val, Ala, Gly, Leu, or Ile
  SITE (1083)..(1083): Xaa at position 1083 is Phe, Tyr, Met, His, Ile, Leu Val, Ala, or Gly
  SITE (1085)..(1085): Xaa at position 1085 is Ile, Ala, Val, Leu, or Gly
  SITE (1090)..(1090): Xaa at position 1090 is Ala, Gly, or Pro
  SITE (1119)..(1119): Xaa at position 1119 is Val, Ala, Gly, Leu, or Ile
  SITE (1121)..(1121): Xaa at position 1121 is Tyr, Phe, Met, His, Ile, Leu Val, Ala, or Gly
  SITE (1129)..(1129): Xaa at position 1129 is Tyr, Phe, Met, His, Ile, Leu Val, Ala, or Gly
  SITE (1131)..(1131): Xaa at position 1131 is Ile, Ala, Val, Leu, or Gly
  SITE (1133)..(1133): Xaa at position 1133 is Ile, Ala, Val, Leu, or Gly
  SITE (1140)..(1140): Xaa at position 1140 is Ile, Ala, Val, Leu, or Gly
  SITE (1147)..(1147): Xaa at position 1147 is Ala, Gly, or Pro
  SITE (1149)..(1149): Xaa at position 1149 is Ile, Ala, Val, Leu, or Gly
  SITE (1158)..(1158): Xaa at position 1158 is Val, Ala, Gly, Leu, or Ile
  SITE (1160)..(1160): Xaa at position 1160 is Ala, Gly, or Pro
  SITE (1178)..(1178): Xaa at position 1178 is Val, Ala, Gly, Leu, or Ile
  SITE (1183)..(1183): Xaa at position 1183 is Ala, Gly, or Pro
  SITE (1192)..(1192): Xaa at position 1192 is Ile, Ala, Val, Leu, or Gly
  SITE (1214)..(1214): Xaa at position 1214 is Ile, Ala, Val, Leu, or Gly
  SITE (1216)..(1216): Xaa at position 1216 is Tyr, Phe, Met, His, Ile, Leu Val, Ala, or Gly
  SITE (1224)..(1224): Xaa at position 1224 is Tyr, Phe, Met, His, Ile, Leu Val, Ala, or Gly
  SITE (1226)..(1226): Xaa at position 1226 is Ile, Ala, Val, Leu, or Gly
  SITE (1228)..(1228): Xaa at position 1228 is Ile, Ala, Val, Leu, or Gly
  SITE (1230)..(1230): Xaa at position 1230 is Tyr, Phe, Met, His, Ile, Leu Val, Ala, or Gly
  SITE (1242)..(1242): Xaa at position 1242 is Val, Ala, Gly, Leu, or Ile
  SITE (1253)..(1253): Xaa at position 1253 is Val, Ala, Gly, Leu, or Ile
  SITE (1265)..(1265): Xaa at position 1265 is Val, Ala, Gly, Leu, or Ile
  SITE (1273)..(1273): Xaa at position 1273 is Phe, Tyr, Met, His, Ile, Leu Val, Ala, or Gly
  SITE (1275)..(1275): Xaa at position 1275 is Val, Ala, Gly, Leu, or Ile
  SITE (1292)..(1292): Xaa at position 1292 is Val, Ala, Gly, Leu, or Ile
  SITE (1312)..(1312): Xaa at position 1312 is Tyr, Phe, Met, His, Ile, Leu Val, Ala, or Gly
  SITE (1314)..(1314): Xaa at position 1314 is Val, Ala, Gly, Leu, or Ile
  SITE (1316)..(1316): Xaa at position 1316 is Tyr, Phe, Met, His, Ile, Leu Val, Ala, or Gly
  SITE (1324)..(1324): Xaa at position 1324 is His, Phe, Tyr, Lys, Arg, Gly Ser, Thr, Ala, Val, Leu, Ile, Asn, Met, or Gln
  SITE (1326)..(1326): Xaa at position 1326 is Val, Ala, Gly, Leu, or Ile
  SITE (1328)..(1328): Xaa at position 1328 is Val, Ala, Gly, Leu, or Ile
  SITE (1342)..(1342): Xaa at position 1342 is Val, Ala, Gly, Leu, or Ile
  SITE (1353)..(1353): Xaa at position 1353 is Val, Ala, Gly, Leu, or Ile
  SITE (1371)..(1371): Xaa at position 1371 is Phe, Tyr, Met, His, Ile, Leu Val, Ala, or Gly
  SITE (1373)..(1373): Xaa at position 1373 is Val, Ala, Gly, Leu, or Ile
  SITE (1378)..(1378): Xaa at position 1378 is Ala, Gly, or Pro
  SITE (1407)..(1407): Xaa at position 1407 is Val, Ala, Gly, Leu, or Ile
  SITE (1409)..(1409): Xaa at position 1409 is Tyr, Phe, Met, His, Ile, Leu Val, Ala, or Gly
  SITE (1417)..(1417): Xaa at position 1417 is Tyr, Phe, Met, His, Ile, Leu Val, Ala, or Gly
  SITE (1419)..(1419): Xaa at position 1419 is Val, Ala, Gly, Leu, or Ile
  SITE (1421)..(1421): Xaa at position 1421 is Ile, Ala, Val, Leu, or Gly
  SITE (1428)..(1428): Xaa at position 1428 is Ile, Ala, Val, Leu, or Gly
  SITE (1435)..(1435): Xaa at position 1435 is Val, Ala, Gly, Leu, or Ile
  SITE (1437)..(1437): Xaa at position 1437 is Val, Ala, Gly, Leu, or Ile
  SITE (1446)..(1446): Xaa at position 1446 is Val, Ala, Gly, Leu, or Ile
  SITE (1457)..(1457): Xaa at position 1457 is Val, Ala, Gly, Leu, or Ile
  SITE (1467)..(1467): Xaa at position 1467 is Val, Ala, Gly, Leu, or Ile
  SITE (1472)..(1472): Xaa at position 1472 is Ala, Gly, or Pro
  SITE (1481)..(1481): Xaa at position 1481 is Val, Ala, Gly, Leu, or Ile
  SITE (1503)..(1503): Xaa at position 1503 is Val, Ala, Gly, Leu, or Ile
  SITE (1515)..(1515): Xaa at position 1515 is Val, Ala, Gly, Leu, or Ile
  SITE (1517)..(1517): Xaa at position 1517 is Val, Ala, Gly, Leu, or Ile
  SITE (1519)..(1519): Xaa at position 1519 is Tyr, Phe, Met, His, Ile, Leu Val, Ala, or Gly
  SITE (1524)..(1524): Xaa at position 1524 is Val, Ala, Gly, Leu, or Ile
  SITE (1531)..(1531): Xaa at position 1531 is Ile, Ala, Val, Leu, or Gly
  SITE (1533)..(1533): Xaa at position 1533 is Val, Ala, Gly, Leu, or Ile
  SITE (1542)..(1542): Xaa at position 1542 is Val, Ala, Gly, Leu, or Ile
  SITE (1554)..(1554): Xaa at position 1554 is Ile, Ala, Val, Leu, or Gly
  SITE (1556)..(1556): Xaa at position 1556 is Ala, Gly, or Pro
  SITE (1562)..(1562): Xaa at position 1562 is Phe, Tyr, Met, His, Ile, Leu Val, Ala, or Gly
  SITE (1564)..(1564): Xaa at position 1564 is Ile, Ala, Val, Leu, or Gly
  SITE (1566)..(1566): Xaa at position 1566 is Ala, Gly, or Pro
  SITE (1569)..(1569): Xaa at position 1569 is Ala, Gly, or Pro
  SITE (1578)..(1578): Xaa at position 1578 is Ile, Ala, Val, Leu, or Gly
  SITE (1600)..(1600): Xaa at position 1600 is Val, Ala, Gly, Leu, or Ile
  SITE (1602)..(1602): Xaa at position 1602 is Tyr, Phe, Met, His, Ile, Leu Val, Ala, or Gly
  SITE (1610)..(1610): Xaa at position 1610 is Tyr, Phe, Met, His, Ile, Leu Val, Ala, or Gly
  SITE (1612)..(1612): Xaa at position 1612 is Ile, Ala, Val, Leu, or Gly
  SITE (1614)..(1614): Xaa at position 1614 is Ile, Ala, Val, Leu, or Gly
  SITE (1616)..(1616): Xaa at position 1616 is Tyr, Phe, Met, His, Ile, Leu Val, Ala, or Gly
  SITE (1621)..(1621): Xaa at position 1621 is Ile, Ala, Val, Leu, or Gly
  SITE (1628)..(1628): Xaa at position 1628 is Ile, Ala, Val, Leu, or Gly
  SITE (1630)..(1630): Xaa at position 1630 is Ala, Gly, or Pro
  SITE (1636)..(1636): Xaa at position 1636 is Ala, Gly, or Pro
  SITE (1639)..(1639): Xaa at position 1639 is Cys, Ala, Val, Gly, Ser, or Thr
  SITE (1666)..(1666): Xaa at position 1666 is Ile, Ala, Val, Leu, or Gly
  SITE (1668)..(1668): Xaa at position 1668 is Val, Ala, Gly, Leu, or Ile
  SITE (1673)..(1673): Xaa at position 1673 is Ala, Gly, or Pro
  SITE (1678)..(1678): Xaa at position 1678 is Val, Ala, Gly, Leu, or Ile
  SITE (1682)..(1682): Xaa at position 1682 is Val, Ala, Gly, Leu, or Ile
  SITE (1704)..(1704): Xaa at position 1704 is Ile, Ala, Val, Leu, or Gly
  SITE (1708)..(1708): Xaa at position 1708 is Ala, Gly, or Pro
  SITE (1714)..(1714): Xaa at position 1714 is Tyr, Phe, Met, His, Ile, Leu Val, Ala, or Gly
  SITE (1716)..(1716): Xaa at position 1716 is Ile, Ala, Val, Leu, or Gly
  SITE (1718)..(1718): Xaa at position 1718 is Ile, Ala, Val, Leu, or Gly
  SITE (1725)..(1725): Xaa at position 1725 is Ile, Ala, Val, Leu, or Gly
  SITE (1732)..(1732): Xaa at position 1732 is Val, Ala, Gly, Leu, or Ile
  SITE (1734)..(1734): Xaa at position 1734 is Ala, Gly, or Pro
  SITE (1793)..(1793): Xaa at position 1793 is Val, Ala, Gly, Leu, or Ile
  SITE (1802)..(1802): Xaa at position 1802 is Val, Ala, Gly, Leu, or Ile
  SITE (1822)..(1822): Xaa at position 1822 is Ile, Ala, Val, Leu, or Gly
  SITE (1824)..(1824): Xaa at position 1824 is Val, Ala, Gly, Leu, or Ile
  SITE (1834)..(1834): Xaa at position 1834 is His, Phe, Tyr, Lys, Arg, Gly Ser, Thr, Ala, Val, Leu, Ile, Asn, Met, or Gln
  SITE (1836)..(1836): Xaa at position 1836 is Met, Ile, Leu, Val, Ala, or Gly
  SITE (1838)..(1838): Xaa at position 1838 is Ile, Ala, Val, Leu, or Gly
  SITE (1845)..(1845): Xaa at position 1845 is Ile, Ala, Val, Leu, or Gly
  SITE (1862)..(1862): Xaa at position 1862 is Val, Ala, Gly, Leu, or Ile
  SITE (1880)..(1880): Xaa at position 1880 is Phe, Tyr, Met, His, Ile, Leu Val, Ala, or Gly
  SITE (1882)..(1882): Xaa at position 1882 is Ile, Ala, Val, Leu, or Gly
  SITE (1916)..(1916): Xaa at position 1916 is Val, Ala, Gly, Leu, or Ile
  SITE (1918)..(1918): Xaa at position 1918 is Tyr, Phe, Met, His, Ile, Leu Val, Ala, or Gly
  SITE (1926)..(1926): Xaa at position 1926 is Tyr, Phe, Met, His, Ile, Leu Val, Ala, or Gly
  SITE (1928)..(1928): Xaa at position 1928 is Ile, Ala, Val, Leu, or Gly
  SITE (1930)..(1930): Xaa at position 1930 is Val, Ala, Gly, Leu, or Ile
  SITE (1932)..(1932): Xaa at position 1932 is Phe, Tyr, Met, His, Ile, Leu Val, Ala, or Gly
  SITE (1937)..(1937): Xaa at position 1937 is Ile, Ala, Val, Leu, or Gly
  SITE (1944)..(1944): Xaa at position 1944 is Ala, Gly, or Pro
  SITE (1946)..(1946): Xaa at position 1946 is Ile, Ala, Val, Leu, or Gly
  SITE (2003)..(2003): Xaa at position 2003 is Ile, Ala, Val, Leu, or Gly
  SITE (2005)..(2005): Xaa at position 2005 is Phe, Tyr, Met, His, Ile, Leu Val, Ala, or Gly
  SITE (2013)..(2013): Xaa at position 2013 is His, Phe, Tyr, Lys, Arg, Gly Ser, Thr, Ala, Val, Leu, Ile, Asn, Met, or Gln
  SITE (2015)..(2015): Xaa at position 2015 is Val, Ala, Gly, Leu, or Ile
  SITE (2017)..(2017): Xaa at position 2017 is Val, Ala, Gly, Leu, or Ile
  SITE (2033)..(2033): Xaa at position 2033 is Val, Ala, Gly, Leu, or Ile
  SITE (2041)..(2041): Xaa at position 2041 is Ala, Gly, or Pro
  SITE (2044)..(2044): Xaa at position 2044 is Val, Ala, Gly, Leu, or Ile
  SITE (2064)..(2064): Xaa at position 2064 is Val, Ala, Gly, Leu, or Ile
  SITE (2098)..(2098): Xaa at position 2098 is Val, Ala, Gly, Leu, or Ile
  SITE (2100)..(2100): Xaa at position 2100 is Tyr, Phe, Met, His, Ile, Leu Val, Ala, or Gly
  SITE (2108)..(2108): Xaa at position 2108 is Tyr, Phe, Met, His, Ile, Leu Val, Ala, or Gly
  SITE (2110)..(2110): Xaa at position 2110 is Ile, Ala, Val, Leu, or Gly
  SITE (2112)..(2112): Xaa at position 2112 is Ile, Ala, Val, Leu, or Gly
  SITE (2114)..(2114): Xaa at position 2114 is Phe, Tyr, Met, His, Ile, Leu Val, Ala, or Gly
  SITE (2126)..(2126): Xaa at position 2126 is Val, Ala, Gly, Leu, or Ile
  SITE (2128)..(2128): Xaa at position 2128 is Val, Ala, Gly, Leu, or Ile
  SITE (2254)..(2254): Xaa at position 2254 is Val, Ala, Gly, Leu, or Ile
  SITE (2274)..(2274): Xaa at position 2274 is Tyr, Phe, Met, His, Ile, Leu Val, Ala, or Gly
  SITE (2276)..(2276): Xaa at position 2276 is Val, Ala, Gly, Leu, or Ile
  SITE (2286)..(2286): Xaa at position 2286 is His, Phe, Tyr, Lys, Arg, Gly Ser, Thr, Ala, Val, Leu, Ile, Asn, Met, or Gln
  SITE (2288)..(2288): Xaa at position 2288 is Val, Ala, Gly, Leu, or Ile
  SITE (2290)..(2290): Xaa at position 2290 is Val, Ala, Gly, Leu, or Ile
  SITE (2306)..(2306): Xaa at position 2306 is Val, Ala, Gly, Leu, or Ile
  SITE (2317)..(2317): Xaa at position 2317 is Val, Ala, Gly, Leu, or Ile
  SITE (2335)..(2335): Xaa at position 2335 is Phe, Tyr, Met, His, Ile, Leu Val, Ala, or Gly
  SITE (2337)..(2337): Xaa at position 2337 is Ile, Ala, Val, Leu, or Gly
  SITE (2371)..(2371): Xaa at position 2371 is Val, Ala, Gly, Leu, or Ile
  SITE (2373)..(2373): Xaa at position 2373 is Tyr, Phe, Met, His, Ile, Leu Val, Ala, or Gly
  SITE (2375)..(2375): Xaa at position 2375 is Val, Ala, Gly, Leu, or Ile
  SITE (2381)..(2381): Xaa at position 2381 is Tyr, Phe, Met, His, Ile, Leu Val, Ala, or Gly
  SITE (2383)..(2383): Xaa at position 2383 is Val, Ala, Gly, Leu, or Ile
  SITE (2385)..(2385): Xaa at position 2385 is Ile, Ala, Val, Leu, or Gly
  SITE (2392)..(2392): Xaa at position 2392 is Ile, Ala, Val, Leu, or Gly
  SITE (2399)..(2399): Xaa at position 2399 is Val, Ala, Gly, Leu, or Ile
  SITE (2401)..(2401): Xaa at position 2401 is Val, Ala, Gly, Leu, or Ile
  SITE (2402)..(2402): Xaa at position 2402 is Ala, Gly, or Pro
  SITE (2408)..(2408): Xaa at position 2408 is Ala, Gly, or Pro
  SITE (2411)..(2411): Xaa at position 2411 is Leu, Ala, Val, Gly, or Ile
  SITE (2421)..(2421): Xaa at position 2421 is Leu, Ala, Val, Gly, or Ile
  SITE (2431)..(2431): Xaa at position 2431 is Val, Ala, Gly, Leu, or Ile
  SITE (2433)..(2433): Xaa at position 2433 is Leu, Ala, Val, Gly, or Ile
  SITE (2436)..(2436): Xaa at position 2436 is Ala, Gly, or Pro
  SITE (2440)..(2440): Xaa at position 2440 is Ile, Ala, Val, Leu, or Gly
  SITE (2444)..(2444): Xaa at position 2444 is Val, Ala, Gly, Leu, or Ile
  SITE (2466)..(2466): Xaa at position 2466 is Ile, Ala, Val, Leu, or Gly
  SITE (2476)..(2476): Xaa at position 2476 is His, Phe, Tyr, Lys, Arg, Gly Ser, Thr, Ala, Val, Leu, Ile, Asn, Met, or Gln
  SITE (2478)..(2478): Xaa at position 2478 is Ile, Ala, Val, Leu, or Gly
  SITE (2480)..(2480): Xaa at position 2480 is Val, Ala, Gly, Leu, or Ile
  SITE (2482)..(2482): Xaa at position 2482 is Phe, Tyr, Met, His, Ile, Leu Val, Ala, or Gly
  SITE (2494)..(2494): Xaa at position 2494 is Ile, Ala, Val, Leu, or Gly
  SITE (2508)..(2508): Xaa at position 2508 is Val, Ala, Gly, Leu, or Ile
  SITE (2515)..(2515): Xaa at position 2515 is Leu, Ala, Val, Gly, or Ile
  SITE (2526)..(2526): Xaa at position 2526 is Phe, Tyr, Met, His, Ile, Leu Val, Ala, or Gly
  SITE (2528)..(2528): Xaa at position 2528 is Val, Ala, Gly, Leu, or Ile
  SITE (2533)..(2533): Xaa at position 2533 is Ala, Gly, or Pro
  SITE (2561)..(2561): Xaa at position 2561 is Val, Ala, Gly, Leu, or Ile
  SITE (2563)..(2563): Xaa at position 2563 is Tyr, Phe, Met, His, Ile, Leu Val, Ala, or Gly
  SITE (2567)..(2567): Xaa at position 2567 is Ala, Gly, or Pro
  SITE (2571)..(2571): Xaa at position 2571 is Tyr, Phe, Met, His, Ile, Leu Val, Ala, or Gly
  SITE (2573)..(2573): Xaa at position 2573 is Ile, Ala, Val, Leu, or Gly
  SITE (2575)..(2575): Xaa at position 2575 is Ile, Ala, Val, Leu, or Gly
  SITE (2577)..(2577): Xaa at position 2577 is Tyr, Phe, Met, His, Ile, Leu Val, Ala, or Gly
  SITE (2583)..(2583): Xaa at position 2583 is Ile, Ala, Val, Leu, or Gly
  SITE (2590)..(2590): Xaa at position 2590 is Ala, Gly, or Pro
  SITE (2635)..(2635): Xaa at position 2635 is Ala, Gly, or Pro
  SITE (2638)..(2638): Xaa at position 2638 is Val, Ala, Gly, Leu, or Ile
  SITE (2648)..(2648): Xaa at position 2648 is Ala, Gly, or Pro
  SITE (2658)..(2658): Xaa at position 2658 is Val, Ala, Gly, Leu, or Ile
  SITE (2660)..(2660): Xaa at position 2660 is Cys, Ala, Val, Gly, Ser, or Thr
  SITE (2663)..(2663): Xaa at position 2663 is Ala, Gly, or Pro
  SITE (2694)..(2694): Xaa at position 2694 is Val, Ala, Gly, Leu, or Ile
  SITE (2696)..(2696): Xaa at position 2696 is Tyr, Phe, Met, His, Ile, Leu Val, Ala, or Gly
  SITE (2698)..(2698): Xaa at position 2698 is Val, Ala, Gly, Leu, or Ile
  SITE (2706)..(2706): Xaa at position 2706 is Leu, Ala, Val, Gly, or Ile
  SITE (2708)..(2708): Xaa at position 2708 is Val, Ala, Gly, Leu, or Ile
  SITE (2710)..(2710): Xaa at position 2710 is Trp, Tyr, Phe, Met, His, Ile Leu, Val, Ala, or Gly
  SITE (2715)..(2715): Xaa at position 2715 is Val, Ala, Gly, Leu, or Ile
  SITE (2722)..(2722): Xaa at position 2722 is Val, Ala, Gly, Leu, or Ile
MMNNSGYSDAGLGLGDETDEMPSTEKDLAEDAPWKKIQQNTXTRWXNEHXKCVGKRXTDXQRDXSDGLRXXAXXEVLSQKRMYRKFHPRPNFRQMKLENXSXXXEXXEREHIKLVSIDSKAXVDGNLKLXXGXXWTXXLHYSXSMPMWEDEDDEDARKQTPKQRXLGWXQNKXPQLPITNXNRDXQDGKXXGXXXDNCXPGLXPDWEAWDPNQPVENXREXXQQXDDWXGXPQXXAPEEXVDPNVDEHSXXTXXSQFPKAKLKPGAPVRSKQLNPKKXIAYGPGIEPQGNTVLQPXHFTXQTVDXGVGEVLXYIEDPEGHTEEAKVVPNNDKDRTYAXSYVPKVAGLXKXTXLXAGQNXERSPFEXNVGMALGDANKVSARGPGLEPVGNVANKPTYFDIYTAGAGTGDVAVVIVDPQGRRDTVEVALEDKGDSTFRCTYRPAMEGPHTVHVAFAGAPITRSPFPVHVSEACNPNACRASGRGLQPKGVRVKEVADFKVFTKGAGSGELKVTVKGPKGTEEPVKVREAGDGVFECEYYPVVPGKYVVTITWGGYAIPRSPFEVQVSPEAGVQKVRAWGPGLETGQVGKSXDXXXEAIGTEVGTLGFSIEGPSQAKIECDDKGDGSXDXRXWPTEPGEXAXHXICDDEDIRDSPFIXHILPAPPDXFPDKVKAFGPGLEPTGCIVDKPXEFTXDARAXGKGDLKLYAQDADGCPIDIKVIPNGDGTFRXSYVPTKPIKHTXXXSWGGVNVPKSPFRXNXGEGSHPERVKVYGPGVEKTGLKANEPTYFTVDCSEAGQGDVSIGIKCAPGVVGPAEADIDFDIIKNDNDTFTVKYTPPGAGRYTIMVLFANQEIPASPFHIKVDPSHDASKVKAEGPGLNRTGVEVGKPTHFTVLTKGAGKAKLDVQFAGTAKGEVVRDFEIIDNHDYSYTVKYTAVQQGNMAVTVTYGGDPVPKSPFVVNVAPPLDLSKIKVQGLNSKVAVGQEQAFSVNTRGAGGQGQLDVRMTSPSRRPIPCKLEPGGGAEAQAVRYMPPEEGPYKVDITYDGHPVPGSPFAVEGVLPPDPSKXCAYGPGLKGGLVGTPAPXSXDTKGXGTGGLGLTVEGPCEAKIECQDNGDGSCAXSXLPTEPGEXTXNXLFAEAHXPGSPFKXTXRPVFDPSKXRXSGPGLERGKVGEAATFTXDCSEXGEAELTIEXLSDAGVKAEVLIHNNADGTYHXTXSPAFPGTXTXTXKXGGHPVPKFPTRXHVQPAVDTSGXKVSGPGVEPHGXLREVTTEXTXDARSLTATGGNHVTARXLNPSGAKTDTYVTDNGDGTXRXQXTAYEEGVXLXEXLYDEVAVPKSPFRXGVTEGCDPTRXRAFGPGLEGGLVNKANRXTXETRGXGTGGLGLAIEGPSEAKMSCKDNKDGSCTXEXIPFTPGDXDXNXTFGGRPXPGSPFRXPXKDVVDPGKXKCSGPGLGAGXRARVPQTFTXDCSQXGRAPLQVAXLGPTGVAEPVEVRDNGDGTHTXHYTPATDGPYTXAXKXADQEXPRSPFKXKXLPAHDASKXRASGPGLNASGXPXSLPVEXTXDXRDXGEGLLTVQXLDPEGKPKKANIRDNGDGTYTXSXLPDMSGRXTXTXKXGGDEXPYSPFRXHXLPTGDXSKXLVTVSIGGHGLGACLGPRIQIGQETVXTXDAKAXGEGKXTCTXSTPDGAELDVDVVENHDGTFDXYYTXPEPGKXVXTXRFGGEHXPNSPFHXLXCDPLPHEEEPSEVPQLRQPYAPPRPGARPTHWATEEPVVPVEPMESMLRPFNLVIPFAXQKGELTGEXRMPSGKTARPNITDNKDGTXTXRYAPTEKGLXQXGXKYDGNHXPGSPLQFYVDAINSRHXSAYGPGLSHGMVNKPATXTXVTKDAGEGGLSLAVEGPSKAEITCKDNKDGTCTXSXLPTAPGDXSXIXRXDDKHXPGSPFTXKXTGDDSMRTSQLNVGTSTDVSLKITESDLSQLTASIRAPSGNEEPCLLKRLPNRHIGXSXTPKEVGEXVXSXRKSGKHVTNSPFKILXGPSEIGDXSKXRVWGKGLSEGHTFQVAEFIXDTRNAGYGGLGLSIEGPSKVDINCEDMEDGTCKXTXCPTEPGTXIXNXKXADKHVPGSPFTXKXTGEGRMKESITRRRQAPSIATIGSTCDLNLKIPGNWFQMVSAQERLTRTFTRSSHTYTRTERTEISKTRGGETKREVRVEESTQVGGDPFPAVFGDFLGRERLGSFGSITRQQEGEASSQDMTAQXTSPSGKVEAAEIVEGEDSAXSXRFVPQEMGPXTXAXKYRGQHVPGSPFQFTXGPLGEGGAHKXRAGGTGLERGVAGVPAEXSXWTREAGAGGLSIAVEGPSKAEIAFEDRKDGSCGXSXVXQEPGDXEXSXKFNDEHXPDSPFVXPXXSLSDDXRRXTVTSLQETGXKVNQPASFAXQXNGXRGVXDARXHTPSGAVEECYVSELDSDKHTXRFIPHENGVXSXDXKXNGAHIPGSPFKXRVGEQSQAGDPGLXSAYGPGXEGGTTGVSSEXIXNTLNXGSGALSVTIDGPSKVQLDCRECPEGHVXTXTPMXPGNXLXAXKXGGPQHXVGSPFKXKVTGPRLSGGHSLHETSTVLVETVTKSSSSRGSSYSSIPKFSSDXSKXVTRGPGLSQXFVGQKNSFTXDXSKXGTNMMMVGVHGPKTPCEEVYVKHMGNRVYNXTXTXKEKGDYIXIXKXGDESXPGSPFKXKVP

SEQ ID NO: 698 - protein, 348 aa, Homo sapiens
  SITE (5)..(5): Xaa at position 5 is Val, Ala, Gly, Leu, or Ile
  SITE (6)..(6): Xaa at position 6 is Leu, Ala, Val, Gly, or Ile
  SITE (7)..(7): Xaa at position 7 is Val, Ala, Gly, Leu, or Ile
  SITE (17)..(17): Xaa at position 17 is His, Phe, Tyr, Lys, Arg, Gly, Ser Thr, Ala, Val, Leu, Ile, Asn, Met, or Gln
  SITE (19)..(19): Xaa at position 19 is Val, Ala, Gly, Leu, or Ile
  SITE (20)..(20): Xaa at position 20 is Leu, Ala, Val, Gly, or Ile
  SITE (22)..(22): Xaa at position 22 is Leu, Ala, Val, Gly, or Ile
  SITE (30)..(30): Xaa at position 30 is Val, Ala, Gly, Leu, or Ile
  SITE (31)..(31): Xaa at position 31 is Val, Ala, Gly, Leu, or Ile
  SITE (32)..(32): Xaa at position 32 is Ile, Ala, Val, Leu, or Gly
  SITE (49)..(49): Xaa at position 49 is Leu, Ala, Val, Gly, or Ile
  SITE (52)..(52): Xaa at position 52 is Val, Ala, Gly, Leu, or Ile
  SITE (60)..(60): Xaa at position 60 is Val, Ala, Gly, Leu, or Ile
  SITE (72)..(72): Xaa at position 72 is Ala, Gly, or Pro
  SITE (73)..(73): Xaa at position 73 is Leu, Ala, Val, Gly, or Ile
  SITE (76)..(76): Xaa at position 76 is Leu, Ala, Val, Gly, or Ile
  SITE (82)..(82): Xaa at position 82 is Phe, Tyr, Met, His, Ile, Leu, Val Ala, or Gly
  SITE (84)..(84): Xaa at position 84 is Ala, Gly, or Pro
  SITE (85)..(85): Xaa at position 85 is Val, Ala, Gly, Leu, or Ile
  SITE (86)..(86): Xaa at position 86 is Ile, Ala, Val, Leu, or Gly
  SITE (87)..(87): Xaa at position 87 is His, Phe, Tyr, Lys, Arg, Gly, Ser Thr, Ala, Val, Leu, Ile, Asn, Met, or Gln
  SITE (104)..(104): Xaa at position 104 is Tyr, Phe, Met, His, Ile, Leu, Val Ala, or Gly
  SITE (115)..(115): Xaa at position 115 is Leu, Ala, Val, Gly, or Ile
  SITE (118)..(118): Xaa at position 118 is Ile, Ala, Val, Leu, or Gly
  SITE (119)..(119): Xaa at position 119 is Met, Ile, Leu, Val, Ala, or Gly
  SITE (124)..(124): Xaa at position 124 is Val, Ala, Gly, Leu, or Ile
  SITE (127)..(127): Xaa at position 127 is Leu, Ala, Val, Gly, or Ile
  SITE (128)..(128): Xaa at position 128 is Val, Ala, Gly, Leu, or Ile
  SITE (129)..(129): Xaa at position 129 is Phe, Tyr, Met, His, Ile, Leu, Val Ala, or Gly
  SITE (133)..(133): Xaa at position 133 is Ala, Gly, or Pro
  SITE (135)..(135): Xaa at position 135 is Val, Ala, Gly, Leu, or Ile
  SITE (136)..(136): Xaa at position 136 is Tyr, Phe, Met, His, Ile, Leu, Val Ala, or Gly
  SITE (144)..(144): Xaa at position 144 is Leu, Ala, Val, Gly, or Ile
  SITE (148)..(148): Xaa at position 148 is His, Phe, Tyr, Lys, Arg, Gly, Ser Thr, Ala, Val, Leu, Ile, Asn, Met, or Gln
  SITE (164)..(164): Xaa at position 164 is Ile, Ala, Val, Leu, or Gly
  SITE (168)..(168): Xaa at position 168 is Ile, Ala, Val, Leu, or Gly
  SITE (178)..(178): Xaa at position 178 is Trp, Tyr, Phe, Met, His, Ile, Leu Val, Ala, or Gly
  SITE (180)..(180): Xaa at position 180 is Ala, Gly, or Pro
  SITE (181)..(181): Xaa at position 181 is Val, Ala, Gly, Leu, or Ile
  SITE (182)..(182): Xaa at position 182 is Leu, Ala, Val, Gly, or Ile
  SITE (183)..(183): Xaa at position 183 is Leu, Ala, Val, Gly, or Ile
  SITE (191)..(191): Xaa at position 191 is Ala, Gly, or Pro
  SITE (197)..(197): Xaa at position 197 is Ile, Ala, Val, Leu, or Gly
  SITE (209)..(209): Xaa at position 209 is Met, Ile, Leu, Val, Ala, or Gly
  SITE (212)..(212): Xaa at position 212 is Val, Ala, Gly, Leu, or Ile
  SITE (225)..(225): Xaa at position 225 is Val, Ala, Gly, Leu, or Ile
  SITE (242)..(242): Xaa at position 242 is Ile, Ala, Val, Leu, or Gly
  SITE (243)..(243): Xaa at position 243 is His, Phe, Tyr, Lys, Arg, Gly, Ser Thr, Ala, Val, Leu, Ile, Asn, Met, or Gln
  SITE (244)..(244): Xaa at position 244 is Val, Ala, Gly, Leu, or Ile
  SITE (247)..(247): Xaa at position 247 is Leu, Ala, Val, Gly, or Ile
  SITE (248)..(248): Xaa at position 248 is Ala, Gly, or Pro
  SITE (251)..(251): Xaa at position 251 is His, Phe, Tyr, Lys, Arg, Gly, Ser Thr, Ala, Val, Leu, Ile, Asn, Met, or Gln
  SITE (253)..(253): Xaa at position 253 is Ala, Gly, or Pro
  SITE (254)..(254): Xaa at position 254 is Ala, Gly, or Pro
  SITE (255)..(255): Xaa at position 255 is Leu, Ala, Val, Gly, or Ile
  SITE (258)..(258): Xaa at position 258 is Leu, Ala, Val, Gly, or Ile
  SITE (267)..(267): Xaa at position 267 is Tyr, Phe, Met, His, Ile, Leu, Val Ala, or Gly
  SITE (269)..(269): Xaa at position 269 is Leu, Ala, Val, Gly, or Ile
  SITE (280)..(280): Xaa at position 280 is Met, Ile, Leu, Val, Ala, or Gly
  SITE (281)..(281): Xaa at position 281 is Val, Ala, Gly, Leu, or Ile
  SITE (283)..(283): Xaa at position 283 is Ala, Gly, or Pro
  SITE (284)..(284): Xaa at position 284 is Met, Ile, Leu, Val, Ala, or Gly
  SITE (309)..(309): Xaa at position 309 is Ala, Gly, or Pro
  SITE (313)..(313): Xaa at position 313 is Leu, Ala, Val, Gly, or Ile
  SITE (314)..(314): Xaa at position 314 is Ala, Gly, or Pro
  SITE (318)..(318): Xaa at position 318 is Leu, Ala, Val, Gly, or Ile
  SITE (320)..(320): Xaa at position 320 is Trp, Tyr, Phe, Met, His, Ile, Leu Val, Ala, or Gly
  SITE (329)..(329): Xaa at position 329 is Met, Ile, Leu, Val, Ala, or Gly
  SITE (330)..(330): Xaa at position 330 is Cys, Ala, Val, Gly, Ser, or Thr
MAEKXXXTGGAGYIGSXTXXEXLEAGYLPXXXDNFHNAFRGGGSLPESXRRXQELTGRSXEFEEMDILDQGXXQRXFKKYSXMXXXXFAGLKAVGESVQKPLDXYRVNLTGTIQXLEXXKAHGXKNXXXSSSXTXXGNPQYLPXDEAXPTGGCTNPYGKSKFFXEEMXRDLCQADKTXNXXXXRYFNPTGXHASGCXGEDPQGIPNNLXPYXSQVAIGRREALNXFGNDYDTEDGTGVRDYXXXVDXXKGXIXXXRKXKEQCGCRIXNXGTGTGYSVLQXXQXXEKASGKKIPYKVVARREGDVAACYXNPSXXQEEXGXTAALGLDRXXEDLWRWQKQNPSGFGTQA

SEQ ID NO: 699 - protein, 771 aa, Homo sapiens
  SITE (110)..(110): Xaa at position 110 is Ile, Ala, Val, Leu, or Gly
  SITE (308)..(308): Xaa at position 308 is Leu, Ala, Val, Gly, or Ile
  SITE (373)..(373): Xaa at position 373 is Val, Ala, Gly, Leu, or Ile
  SITE (451)..(451): Xaa at position 451 is Ile, Ala, Val, Leu, or Gly
  SITE (475)..(475): Xaa at position 475 is Val, Ala, Gly, Leu, or Ile
  SITE (476)..(476): Xaa at position 476 is Leu, Ala, Val, Gly, or Ile
  SITE (494)..(494): Xaa at position 494 is Leu, Ala, Val, Gly, or Ile
  SITE (529)..(529): Xaa at position 529 is Leu, Ala, Val, Gly, or Ile
MGWLTRIVCLFWGVLLTARANYQNGKNNVPRLKLSYKEMLESNNVITFNGLANSSSYHTFLLDEERSRLYVGAKDHIFSFDLVNIKDFQKIVWPVSYTRRDECKWAGKDXLKECANFIKVLKAYNQTHLYACGTGAFHPICTYIEIGHHPEDNIFKLENSHFENGRGKSPYDPKLLTASLLIDGELYSGTAADFMGRDFAIFRTLGHHHPIRTEQHDSRWLNDPKFISAHLISESDNPEDDKVYFFFRENAIDGEHSGKATHARIGQICKNDFGGHRSLVNKWTTFLKARLICSVPGPNGIDTHFDEXQDVFLMNFKDPKNPVVYGVFTTSSNIFKGSAVCMYSMSDVRRVFLGPYAHRDGPNYQWVPYQGRXPYPRPGTCPSKTFGGFDSTKDLPDDVITFARSHPAMYNPVFPMNNRPIVIKTDVNYQFTQIVVDRVDAEDGQYDVMFXGTDVGTVLKVVSIPKETWYDLEEXXLEEMTVFREPTAISAMEXSTKQQQLYIGSTAGVAQLPLHRCDIYGKACAECCXARDPYCAWDGSACSRYFPTAKRRTRRQDIRNGDPLTHCSDLHHDNHHGHSPEERIIYGVENSSTFLECSPKSQRALVYWQFQRRNEERKEEIRVDDHIIRTDQGLLLRSLQQKDSGNYLCHAVEHGFIQTLLKVTLEVIDTEHLEELLHKDDDGDGSKTKEMSNSMTPSQKVWYRDFMQLINHPNLNTMDEFCEQVWKRDRKQRRQRPGHTPGNSNKWKHLQENKKGRNRRTHEFERAPRSV

SEQ ID NO: 700 - protein, 2701 aa, Homo sapiens
  SITE (9)..(9): Xaa at position 9 is Leu, Ala, Val, Gly, or Ile
  SITE (11)..(11): Xaa at position 11 is Ile, Ala, Val, Leu, or Gly
  SITE (15)..(15): Xaa at position 15 is Val, Ala, Gly, Leu, or Ile
  SITE (19)..(19): Xaa at position 19 is Ala, Gly, or Pro
  SITE (27)..(27): Xaa at position 27 is Ile, Ala, Val, Leu, or Gly
  SITE (37)..(37): Xaa at position 37 is Cys, Ala, Val, Gly, Ser, or Thr
  SITE (38)..(38): Xaa at position 38 is Val, Ala, Gly, Leu, or Ile
  SITE (39)..(39): Xaa at position 39 is Val, Ala, Gly, Leu, or Ile
  SITE (66)..(66): Xaa at position 66 is Tyr, Phe, Met, His, Ile, Leu, Val Ala, or Gly
  SITE (115)..(115): Xaa at position 115 is Val, Ala, Gly, Leu, or Ile
  SITE (123)..(123): Xaa at position 123 is Leu, Ala, Val, Gly, or Ile
  SITE (125)..(125): Xaa at position 125 is His, Phe, Tyr, Lys, Arg, Gly, Ser Thr, Ala, Val, Leu, Ile, Asn, Met, or Gln
  SITE (132)..(132): Xaa at position 132 is Leu, Ala, Val, Gly, or Ile
  SITE (146)..(146): Xaa at position 146 is Ala, Gly, or Pro
  SITE (161)..(161): Xaa at position 161 is Phe, Tyr, Met, His, Ile, Leu, Val Ala, or Gly
  SITE (176)..(176): Xaa at position 176 is Ile, Ala, Val, Leu, or Gly
  SITE (193)..(193): Xaa at position 193 is Leu, Ala, Val, Gly, or Ile
  SITE (209)..(209): Xaa at position 209 is Val, Ala, Gly, Leu, or Ile
  SITE (218)..(218): Xaa at position 218 is Trp, Tyr, Phe, Met, His, Ile, Leu Val, Ala, or Gly
  SITE (242)..(242): Xaa at position 242 is Leu, Ala, Val, Gly, or Ile
  SITE (244)..(244): Xaa at position 244 is His, Phe, Tyr, Lys, Arg, Gly, Ser Thr, Ala, Val, Leu, Ile, Asn, Met, or Gln
  SITE (253)..(253): Xaa at position 253 is Cys, Ala, Val, Gly, Ser, or Thr
  SITE (264)..(264): Xaa at position 264 is Leu, Ala, Val, Gly, or Ile
  SITE (280)..(280): Xaa at position 280 is Ala, Gly, or Pro
  SITE (282)..(282): Xaa at position 282 is Trp, Tyr, Phe, Met, His, Ile, Leu Val, Ala, or Gly
  SITE (284)..(284): Xaa at position 284 is Ile, Ala, Val, Leu, or Gly
  SITE (307)..(307): Xaa at position 307 is His, Phe, Tyr, Lys, Arg, Gly, Ser Thr, Ala, Val, Leu, Ile, Asn, Met, or Gln
  SITE (315)..(315): Xaa at position 315 is Ala, Gly, or Pro
  SITE (316)..(316): Xaa at position 316 is Ala, Gly, or Pro
  SITE (354)..(354): Xaa at position 354 is Leu, Ala, Val, Gly, or Ile
  SITE (367)..(367): Xaa at position 367 is Phe, Tyr, Met, His, Ile, Leu, Val Ala, or Gly
  SITE (391)..(391): Xaa at position 391 is His, Phe, Tyr, Lys, Arg, Gly, Ser Thr, Ala, Val, Leu, Ile, Asn, Met, or Gln
  SITE (398)..(398): Xaa at position 398 is Val, Ala, Gly, Leu, or Ile
  SITE (417)..(417): Xaa at position 417 is Ile, Ala, Val, Leu, or Gly
  SITE (429)..(429): Xaa at position 429 is Phe, Tyr, Met, His, Ile, Leu, Val Ala, or Gly
  SITE (448)..(448): Xaa at position 448 is Ala, Gly, or Pro
  SITE (452)..(452): Xaa at position 452 is Leu, Ala, Val, Gly, or Ile
  SITE (476)..(476): Xaa at position 476 is Leu, Ala, Val, Gly, or Ile
  SITE (483)..(483): Xaa at position 483 is Val, Ala, Gly, Leu, or Ile
  SITE (514)..(514): Xaa at position 514 is Ile, Ala, Val, Leu, or Gly
  SITE (518)..(518): Xaa at position 518 is Val, Ala, Gly, Leu, or Ile
  SITE (556)..(556): Xaa at position 556 is Cys, Ala, Val, Gly, Ser, or Thr
  SITE (562)..(562): Xaa at position 562 is His, Phe, Tyr, Lys, Arg, Gly, Ser Thr, Ala, Val, Leu, Ile, Asn, Met, or Gln
MTEKMSSFXYXGDIXSLYXEGSVNGFXSTLGLVDDRXXXHPEAGDLANPPKKFRDCLFKVCPMNRXSAQKQYWKAKQAKQGNHTEAALLKKLQHAAELEQKQNESENKKLLGEIXKYSNVIQXLXIKSNKYXTVNKRLPALLEKNXMRVSLDAAGNEGSWXYIHPFWKLRSEGDNXVVGDKVVLMPVNAGQPXHASNIELLDNPGCKEXNAVNCNTSXKITLFMKYSSYREDVLKGGDVVRXFXAEQEKFLTXDEYEKKQHIFXRTTLRQSATSATSSKXLXEXEVVHHDPCRGGAGQWNSLFRFKXLATGNYLXXELNPDYRDAQNEGKNVRDGVPPTSKKKRQAGEKIMYTXVSVPHGNDIASLXELDATTLQRADCLVPRNSYVRLRXLCTNTWXTSTSIPIDTDEERPVMLKXGTCQTKEDKEAXAIVSVPLSEVRDLDFANDXNKVXATTVKKLENGTITQNERRFVTKLXEDLIFFXADVPNNGQEVLDVVITKPNRERQKLMREQNXLAQXFGILKAPFKEKAGEGSMLRLEDLGDQRYAPYKYMLRLXYRVLRXSQQDYRKNQEYIAKNFCVMQSQIGYDILAEDTITALLHNNRKLLEKHITAKEIETFVSLLRRNREPRFLDYLSDLCVSNTTAIPVTQELICKFMLSPGNADILIQTKVVSMQADNPMESSILSDDIDDEEVWLYWIDSNKEPHGKAIRHLAQEAKEGTKADLEVLTYYRYQLNLFARMCLDRQYLAINQISTQLSVDLILRCVSDESLPFDLRASFCRLMLHMHVDRDPQESVVPVRYARLWTEIPTKITIHEYDSITDSSRNDMKRKFALTMEFVEEYLKEVVNQPFPFGDKEKNKLTFEVVHLARNLIYFGFYSFSELLRLTRTLLAILDIVQAPMSSYFERLSKFQDGGNNVMRTIHGVGEMMTQMVLSRGSIFPMSVPDVPPSIHPSKQGSPTEHEDVTVMDTKLKIIEILQFILSVRLDYRISYMLSIYKKEFGEDNDNAETSASGSPDTLLPSAIVPDIDEIAAQAETMFAGRKEKNPVQLDDEGGRTFLRVLIHLIMHDYPPLLSGALQLLFKHFSQRAEVLQAFKQVQLLVSNQDVDNYKQIKADLDQLRLTVEKSELWVEKSSNYENGEIGESQVKGGEEPIEESNILSPVQDGTKKPQIDSNKSNNYRIVKEILIRLSKLCVQNKKCRNQHQRLLKNMGAHSVVLDLLQIPYEKNDEKMNEVMNLAHTFLQNFCRGNPQNQVLLHKHLNLFLTPGLLEAETMRHIFMNNYHLCNEISERVVQHFVHCIETHGRHVEYLRFLQTIVKADGKYVKKCQDMVMTELINGGEDVLIFYNDRASFPILLHMMCSERDRGDESGPLAYHITLVELLAACTEGKNVYTEIKCNSLLPLDDIVRVVTHDDCIPEVKIAYVNFVNHCYVDTEVEMKEIYTSNHIWKLFENFLVDMARVCNTTTDRKHADIFLEKCVTESIMNIVSGFFNSPFSDNSTSLQTHQPVFIQLLQSAFRIYNCTWPNPAQKASVESCIRTLAEVAKNRGIAIPVDLDSQVNTLFMKSHSNMVQRAAMGWRLSARSGPRFKEALGGPAWDYRNIIEKLQDVVASLEHQFSPMMQAEFSVLVDVLYSPELLFPEGSDARIRCGAFMSKLINHTKKLMEKEEKLCIKILQTLREMLEKKDSFVEEGNTLRKILLNRYFKGDYSIGVNGHLSGAYSKTAQVGGSFSGQDSDKMGISMSDIQCLLDKEGASELVIDVIVNTKNDRIFSEGIFLGIALLEGGNTQTQYSFYQQLHEQKKSEKFFKVLYDRMKAAQKEIRSTVTVNTIDLGNKKRDDDNELMTSGPRMRVRDSTLHLKEGMKGQLTEASSATSKAYCVYRREMDPEIDIMCTGPEAGNTEEKSAEEVTMSPAIAIMQPILRFLQLLCENHNRELQNFLRNQNNKTNYNLVCETLQFLDCICGSTTGGLGLLGLYINEKNVALVNQNLESLTEYCQGPCHENQTCIATHESNGIDIIIALILNDINPLGKYRMDLVLQLKNNASKLLLAIMESRHDSENAERILFNMRPRELVDVMKNAYNQGLECDHGDDEGGDDGVSPKDVGHNIYILAHQLARHNKLLQQMLKPGSDPDEGDEALKYYANHTAQIEIVRHDRTMEQIVFPVPNICEYLTRESKCRVFNTTERDEQGSKVNDFFQQTEDLYNEMKWQKKIRNNPALFWFSRHISLWGSISFNLAVFINLAVALFYPFGDDGDEGTLSPLFSVLLWIAVAICTSMLFFFSKPVGIRPFLVSIMLRSIYTIGLGPTLILLGAANLCNKIVFLVSFVGNRGTFTRGYRAVILDMAFLYHVAYVLVCMLGLFVHEFFYSFLLFDLVYREETLLNVIKSVTRNGRSIILTAVLALILVYLFSIIGFLFLKDDFTMEVDRLKNRTPVTGSHQVPTMTLTTMMEACAKENCSPTIPASNTADEEYEDGIERTCDTLLMCIVTVLNQGLRNGGGVGDVLRRPSKDEPLFAARVVYDLLFYFIVIIIVLNLIFGVIIDTFADLRSEKQKKEEILKTTCFICGLERDKFDNKTVSFEEHIKSEHNMWHYLYFIVLVKVKDPTEYTGPESYVAQMIVEKNLDWFPRMRAMSLVSNEGDSEQNEIRSLQEKLESTMSLVKQLSGQLAELKEQMTEQRKNKQRLGFLGSNTPHVNHHMPPH

SEQ ID NO: 701 - protein, 2671 aa, Homo sapiens
  SITE (8)..(8): Xaa at position 8 is Leu, Ala, Val, Gly, or Ile
  SITE (10)..(10): Xaa at position 10 is Ile, Ala, Val, Leu, or Gly
  SITE (14)..(14): Xaa at position 14 is Val, Ala, Gly, Leu, or Ile
  SITE (18)..(18): Xaa at position 18 is Ala, Gly, or Pro
  SITE (26)..(26): Xaa at position 26 is Ile, Ala, Val, Leu, or Gly
  SITE (36)..(36): Xaa at position 36 is Cys, Ala, Val, Gly, Ser, or Thr
  SITE (37)..(37): Xaa at position 37 is Val, Ala, Gly, Leu, or Ile
  SITE (38)..(38): Xaa at position 38 is Val, Ala, Gly, Leu, or Ile
  SITE (65)..(65): Xaa at position 65 is Tyr, Phe, Met, His, Ile, Leu, Val Ala, or Gly
  SITE (116)..(116): Xaa at position 116 is Val, Ala, Gly, Leu, or Ile
  SITE (124)..(124): Xaa at position 124 is Leu, Ala, Val, Gly, or Ile
  SITE (126)..(126): Xaa at position 126 is His, Phe, Tyr, Lys, Arg, Gly, Ser Thr, Ala, Val, Leu, Ile, Asn, Met, or Gln
  SITE (133)..(133): Xaa at position 133 is Leu, Ala, Val, Gly, or Ile
  SITE (147)..(147): Xaa at position 147 is Ala, Gly, or Pro
  SITE (162)..(162): Xaa at position 162 is Leu, Ala, Val, Gly, or Ile
  SITE (177)..(177): Xaa at position 177 is Val, Ala, Gly, Leu, or Ile
  SITE (194)..(194): Xaa at position 194 is Leu, Ala, Val, Gly, or Ile
  SITE (210)..(210): Xaa at position 210 is Val, Ala, Gly, Leu, or Ile
  SITE (219)..(219): Xaa at position 219 is Trp, Tyr, Phe, Met, His, Ile, Leu Val, Ala, or Gly
  SITE (243)..(243): Xaa at position 243 is Leu, Ala, Val, Gly, or Ile
  SITE (245)..(245): Xaa at position 245 is His, Phe, Tyr, Lys, Arg, Gly, Ser Thr, Ala, Val, Leu, Ile, Asn, Met, or Gln
  SITE (254)..(254): Xaa at position 254 is Cys, Ala, Val, Gly, Ser, or Thr
  SITE (265)..(265): Xaa at position 265 is Leu, Ala, Val, Gly, or Ile
  SITE (281)..(281): Xaa at position 281 is Ala, Gly, or Pro
  SITE (283)..(283): Xaa at position 283 is Trp, Tyr, Phe, Met, His, Ile, Leu Val, Ala, or Gly
  SITE (285)..(285): Xaa at position 285 is Val, Ala, Gly, Leu, or Ile
  SITE (308)..(308): Xaa at position 308 is His, Phe, Tyr, Lys, Arg, Gly, Ser Thr, Ala, Val, Leu, Ile, Asn, Met, or Gln
  SITE (316)..(316): Xaa at position 316 is Ala, Gly, or Pro
  SITE (317)..(317): Xaa at position 317 is Ala, Gly, or Pro
  SITE (354)..(354): Xaa at position 354 is Leu, Ala, Val, Gly, or Ile
  SITE (367)..(367): Xaa at position 367 is Phe, Tyr, Met, His, Ile, Leu, Val Ala, or Gly
  SITE (391)..(391): Xaa at position 391 is His, Phe, Tyr, Lys, Arg, Gly, Ser Thr, Ala, Val, Leu, Ile, Asn, Met, or Gln
  SITE (398)..(398): Xaa at position 398 is Ile, Ala, Val, Leu, or Gly
  SITE (417)..(417): Xaa at position 417 is Leu, Ala, Val, Gly, or Ile
  SITE (429)..(429): Xaa at position 429 is Phe, Tyr, Met, His, Ile, Leu, Val Ala, or Gly
  SITE (448)..(448): Xaa at position 448 is Ala, Gly, or Pro
  SITE (452)..(452): Xaa at position 452 is Leu, Ala, Val, Gly, or Ile
  SITE (476)..(476): Xaa at position 476 is Leu, Ala, Val, Gly, or Ile
  SITE (483)..(483): Xaa at position 483 is Val, Ala, Gly, Leu, or Ile
  SITE (514)..(514): Xaa at position 514 is Ile, Ala, Val, Leu, or Gly
  SITE (518)..(518): Xaa at position 518 is Val, Ala, Gly, Leu, or Ile
  SITE (556)..(556): Xaa at position 556 is Cys, Ala, Val, Gly, Ser, or Thr
  SITE (562)..(562): Xaa at position 562 is His, Phe, Tyr, Lys, Arg, Gly, Ser Thr, Ala, Val, Leu, Ile, Asn, Met, or Gln
MSEMSSFXHXGDIXSLYXEGSVNGFXSTLGLVDDRXXXEPAAGDLDNPPKKFRDCLFKVCPMNRXSAQKQYWKAKQTKQDKEKIADVVLLQKLQHAAQMEQKQNDTENKKVHGDVXKYGSVIQXLXMKSNKYXTVNKRLPALLEKNXMRVTLDATGNEGSWXFIQPFWKLRSNGDNXVVGDKVILNPVNAGQPXHASNYELSDNAGCKEXNSVNCNTSXKINLFMQFRDHLEEVLKGGDVVRXFXAEQEKFLTXDEYKGKLQVFXRTTLRQSATSATSSNXLXEXEVVHHDPCRGGAGHWNGLYRFKXLATGNYLXXEENPSYKGDASDPKAAGMGAQGRTGRRNAGEKIKYCXVAVPHGNDIASLXELDPTTLQKTDSFVPRNSYVRLRXLCTNTWXQSTNVPIDIEEERPIRLMXGTCPTKEDKEAXAIVSVPVSEIRDLDFANDXSSMXASAVEKLNEGFISQNDRRFVIQLXEDLVFFXSDVPNNGQNVLDIMVTKPNRERQKLMREQNXLKQXFGILKAPFREKGGEGPLVRLEELSDQKNAPYQHMFRLXYRVLRXSQEDYRKNQEHIAKQFGMMQSQIGYDILAEDTITALLHNNRKLLEKHITKTEVETFVSLVRKNREPRFLDYLSDLCVSNHIAIPVTQELICKCVLDPKNSDILIRTELRPVKEMAQSHEYLSIEYSEEEVWLTWTDKNNEHHEKSVRQLAQEARAGNAHDENVLSYYRYQLKLFARMCLDRQYLAIDEISQQLGVDLIFLCMADEMLPFDLRASFCHLMLHVHVDRDPQELVTPVKFARLWTEIPTAITIKDYDSNLNASRDDKKNKFANTMEFVEDYLNNVVSEAVPFANEEKNKLTFEVVSLAHNLIYFGFYSFSELLRLTRTLLGIIDCVQGPPAMLQAYEDPGGKNVRRSIQGVGHMMSTMVLSRKQSVFSAPSLSAGASAAEPLDRSKFEENEDIVVMETKLKILEILQFILNVRLDYRISYLLSVFKKEFVEVFPMQDSGADGTAPAFDSTTANMNLDRIGEQAEAMFGVGKTSSMLEVDDEGGRMFLRVLIHLTMHDYAPLVSGALQLLFKHFSQRQEAMHTFKQVQLLISAQDVENYKVIKSELDRLRTMVEKSELWVDKKGSGKGEEVEAGAAKDKKERPTDEEGFLHPPGEKSSENYQIVKGILERLNKMCGVGEQMRKKQQRLLKNMDAHKVMLDLLQIPYDKGDAKMMEILRYTHQFLQKFCAGNPGNQALLHKHLHLFLTPGLLEAETMQHIFLNNYQLCSEISEPVLQHFVHLLATHGRHVQYLDFLHTVIKAEGKYVKKCQDMIMTELTNAGDDVVVFYNDKASLAHLLDMMKAARDGVEDHSPLMYHISLVDLLAACAEGKNVYTEIKCTSLLPLEDVVSVVTHEDCITEVKMAYVNFVNHCYVDTEVEMKEIYTSNHIWTLFENFTLDMARVCSKREKRVADPTLEKYVLSVVLDTINAFFSSPFSENSTSLQTHQTIVVQLLQSTTRLLECPWLQQQHKGSVEACIRTLAMVAKGRAILLPMDLDAHISSMLSSGASCAAAAQRNASSYKATTRAFPRVTPTANQWDYKNIIEKLQDIITALEERLKPLVQAELSVLVDVLHWPELLFLEGSEAYQRCESGGFLSKLIQHTKDLMESEEKLCIKVLRTLQQMLLKKTKYGDRGNQLRKMLLQNYLQNRKSTSRGDLPDPIGTGLDPDWSAIAATQCRLDKEGATKLVCDLITSTKNEKIFQESIGLAIHLLDGGNTEIQKSFHNLMMSDKKSERFFKVLHDRMKRAQQETKSTVAVNMNDLGSQPHEDREPVDPTTKGRVASFSIPGSSSRYSLGPSLRRGHEVSERVQSSEMGTSVLIMQPILRFLQLLCENHNRDLQNFLRCQNNKTNYNLVCETLQFLDIMCGSTTGGLGLLGLYINEDNVGLVIQTLETLTEYCQGPCHENQTCIVTHESNGIDIITALILNDISPLCKYRMDLVLQLKDNASKLLLALMESRHDSENAERILISLRPQELVDVIKKAYLQEEERENSEVSPREVGHNIYILALQLSRHNKQLQHLLKPVKRIQEEEAEGISSMLSLNNKQLSQMLKSSAPAQEEEEDPLAYYENHTSQIEIVRQDRSMEQIVFPVPGICQFLTEETKHRLFTTTEQDEQGSKVSDFFDQSSFLHNEMEWQRKLRSMPLIYWFSRRMTLWGSISFNLAVFINIIIAFFYPYMEGASTGVLDSPLISLLFWILICFSIAALFTKRYSIRPLIVALILRSIYYLGIGPTLNILGALNLTNKIVFVVSFVGNRGTFIRGYKAMVMDMEFLYHVGYILTSVLGLFAHELFYSILLFDLIYREETLFNVIKSVTRNGRSILLTALLALILVYLFSIVGFLFLKDDFILEVDRLPNNHSTASPLGMPHGAAAFVDTCSGDKMDCVSGLSVPEVLEEDRELDSTERACDTLLMCIVTVMNHGLRNGGGVGDILRKPSKDESLFPARVVYDLLFFFIVIIIVLNLIFGVIIDTFADLRSEKQKKEEILKTTCFICGLERDKFDNKTVSFEEHIKLEHNMWNYLYFIVLVRVKNKTDYTGPESYVAQMIKNKNLDWFPRMRAMSLVSNEGEGEQNEIRILQDKLNSTMKLVSHLTAQLNELKEQMTEQRKRRQRLGFVDVQNCISR

SEQ ID NO: 702 - protein, 390 aa, Homo sapiens
  SITE (149)..(149): Xaa at position 149 is Leu, Ala, Val, Gly, or Ile
  SITE (233)..(233): Xaa at position 233 is Leu, Ala, Val, Gly, or Ile
  SITE (255)..(255): Xaa at position 255 is Leu, Ala, Val, Gly, or Ile
  SITE (287)..(287): Xaa at position 287 is Leu, Ala, Val, Gly, or Ile
MLSRKGIIPEEYVLTRLAEDPAEPRYRARQRRARFVSKKGNCNVAHKNIREQGRFLQDVFTTLVDLKWPHTLLIFTMSFLCSWLLFAMAWWLIAFAHGDLAPSEGTAEPCVTSIHSFSSAFLFSIEVQVTIGFGGRMVTEECPLAILIXIVQNIVGLMINAIMLGCIFMKTAQAHRRAETLIFSKHAVIALRHGRLCFMLRVGDLRKSMIISATIHMQVVRKTTSPEGEVVPXHQVDIPMENGVGGNSIFLVAPXIIYHVIDANSPLYDLAPSDLHHHQDLEIIVIXEGVVETTGITTQARTSYLADEILWGQRFVPIVAEEDGRYSVDYSKFGNTIKVPTPLCTARQLDEDHSLLEALTLASARGPLRKRSVPMAKAKPKFSISPDSLS

SEQ ID NO: 703 - protein, 912 aa, Homo sapiens
  SITE (83)..(83): Xaa at position 83 is Leu, Ala, Val, Gly, or Ile
  SITE (86)..(86): Xaa at position 86 is Leu, Ala, Val, Gly, or Ile
  SITE (328)..(328): Xaa at position 328 is Ala, Gly, or Pro
  SITE (341)..(341): Xaa at position 341 is Val, Ala, Gly, Leu, or Ile
  SITE (353)..(353): Xaa at position 353 is Leu, Ala, Val, Gly, or Ile
  SITE (363)..(363): Xaa at position 363 is Ala, Gly, or Pro
MPGKRGLGWWWARLPLCLLLSLYGPWMPSSLGKPKGHPHMNSIRIDGDITLGGLFPVHGRGSEGKPCGELKKEKGIHRLEAMXFAXDRINNDPDLLPNITLGARILDTCSRDTHALEQSLTFVQALIEKDGTEVRCGSGGPPIITKPERVVGVIGASGSSVSIMVANILRLFKIPQISYASTAPDLSDNSRYDFFSRVVPSDTYQAQAMVDIVRALKWNYVSTVASEGSYGESGVEAFIQKSREDGGVCIAQSVKIPREPKAGEFDKIIRRLLETSNARAVIIFANEDDIRRVLEAARRANQTGHFFWMGSDSWGSKIAPVLHLEEVXEGAVTILPKRMSXRGFDRYFSSRTXDNNRRNIWFXEFWEDNFHCKLSRHALKKGSHVKKCTNRERIGQDSAYEQEGKVQFVIDAVYAMGHALHAMHRDLCPGRVGLCPRMDPVDGTQLLKYIRNVNFSGIAGNPVTFNENGDAPGRYDIYQYQLRNDSAEYKVIGSWTDHLHLRIERMHWPGSGQQLPRSICSLPCQPGERKKTVKGMPCCWHCEPCTGYQYQVDRYTCKTCPYDMRPTENRTGCRPIPIIKLEWGSPWAVLPLFLAVVGIAATLFVVITFVRYNDTPIVKASGRELSYVLLAGIFLCYATTFLMIAEPDLGTCSLRRIFLGLGMSISYAALLTKTNRIYRIFEQGKRSVSAPRFISPASQLAITFSLISLQLLGICVWFVVDPSHSVVDFQDQRTLDPRFARGVLKCDISDLSLICLLGYSMLLMVTCTVYAIKTRGVPETFNEAKPIGFTMYTTCIVWLAFIPIFFGTSQSADKLYIQTTTLTVSVSLSASVSLGMLYMPKVYIILFHPEQNVPKRKRSLKAVVTAATMSNKFTQKGNFRPNGEAKSELCENLEAPALATKQTYVTYTNHAI

SEQ ID NO: 704 - protein, 572 aa, Homo sapiens
  SITE (274)..(274): Xaa at position 274 is Leu, Ala, Val, Gly, or Ile
  SITE (279)..(279): Xaa at position 279 is Ile, Ala, Val, Leu, or Gly
  SITE (283)..(283): Xaa at position 283 is Trp, Tyr, Phe, Met, His, Ile, Leu Val, Ala, or Gly
  SITE (285)..(285): Xaa at position 285 is Phe, Tyr, Met, His, Ile, Leu, Val Ala, or Gly
  SITE (293)..(293): Xaa at position 293 is Val, Ala, Gly, Leu, or Ile
  SITE (299)..(299): Xaa at position 299 is Val, Ala, Gly, Leu, or Ile
  SITE (303)..(303): Xaa at position 303 is Tyr, Phe, Met, His, Ile, Leu, Val Ala, or Gly
  SITE (309)..(309): Xaa at position 309 is Phe, Tyr, Met, His, Ile, Leu, Val Ala, or Gly
  SITE (317)..(317): Xaa at position 317 is Ala, Gly, or Pro
MECLYYFLGFLLLAARLPLDAAKRFHDVLGNERPSAYMREHNQLNGWSSDENDWNEKLYPVWKRGDMRWKNSWKGGRVQAVLTSDSPALVGSNITFAVNLIFPRCQKEDANGNIVYEKNCRNEAGLSADPYVYNWTAWSEDSDGENGTGQSHHNVFPDGKPFPHHPGWRRWNFIYVFHTLGQYFQKLGRCSVRVSVNTANVTLGPQLMEVTVYRRHGRAYVPIAQVKDVYVVTDQIPVFVTMFQKNDRNSSDETFLKDLPIMFDVLIHDPSHFXNYSTXNYKXSXGDNTGLFXSTNHTXNHTXVLNGTXSLNLTVKXAAPGPCPPPPPPPRPSKPTPSLATTLKSYDSNTPGPAGDNPLELSRIPDENCQINRYGHFQATITIVEGILEVNIIQMTDVLMPVPWPESSLIDFVVTCQGSIPTEVCTIISDPTCEITQNTVCSPVDVDEMCLLTVRRTFNGSGTYCVNLTLGDDTSLALTSTLISVPDRDPASPLRMANSALISVGCLAIFVTVISLLVYKKHKEYNPIENSPGNVVRSKGLSVFLNRAKAVFFPGNQEKDPLLKNQEFKGVS

SEQ ID NO: 705 - protein, 876 aa, Homo sapiens
  SITE (6)..(6): Xaa at position 6 is Ile, Ala, Val, Leu, or Gly
  SITE (7)..(7): Xaa at position 7 is Leu, Ala, Val, Gly, or Ile
  SITE (21)..(21): Xaa at position 21 is Ala, Gly, or Pro
  SITE (25)..(25): Xaa at position 25 is Leu, Ala, Val, Gly, or Ile
  SITE (40)..(40): Xaa at position 40 is Leu, Ala, Val, Gly, or Ile
  SITE (44)..(44): Xaa at position 44 is Leu, Ala, Val, Gly, or Ile
  SITE (53)..(53): Xaa at position 53 is Ala, Gly, or Pro
  SITE (56)..(56): Xaa at position 56 is Ala, Gly, or Pro
  SITE (57)..(57): Xaa at position 57 is Ala, Gly, or Pro
  SITE (59)..(59): Xaa at position 59 is Leu, Ala, Val, Gly, or Ile
  SITE (61)..(61): Xaa at position 61 is Ile, Ala, Val, Leu, or Gly
  SITE (65)..(65): Xaa at position 65 is Leu, Ala, Val, Gly, or Ile
  SITE (80)..(80): Xaa at position 80 is Trp, Tyr, Phe, Met, His, Ile, Leu Val, Ala, or Gly
  SITE (91)..(91): Xaa at position 91 is Val, Ala, Gly, Leu, or Ile
  SITE (95)..(95): Xaa at position 95 is Val, Ala, Gly, Leu, or Ile
  SITE (109)..(109): Xaa at position 109 is Ala, Gly, or Pro
  SITE (112)..(112): Xaa at position 112 is Cys, Ala, Val, Gly, Ser, or Thr
  SITE (113)..(113): Xaa at position 113 is Val, Ala, Gly, Leu, or Ile
  SITE (114)..(114): Xaa at position 114 is Ala, Gly, or Pro
  SITE (116)..(116): Xaa at position 116 is Ile, Ala, Val, Leu, or Gly
  SITE (117)..(117): Xaa at position 117 is Ala, Gly, or Pro
  SITE (129)..(129): Xaa at position 129 is Leu, Ala, Val, Gly, or Ile
  SITE (133)..(133): Xaa at position 133 is Leu, Ala, Val, Gly, or Ile
  SITE (137)..(137): Xaa at position 137 is Val, Ala, Gly, Leu, or Ile
  SITE (151)..(151): Xaa at position 151 is Leu, Ala, Val, Gly, or Ile
  SITE (153)..(153): Xaa at position 153 is Ala, Gly, or Pro
  SITE (157)..(157): Xaa at position 157 is Ile, Ala, Val, Leu, or Gly
  SITE (161)..(161): Xaa at position 161 is Ile, Ala, Val, Leu, or Gly
  SITE (166)..(166): Xaa at position 166 is Leu, Ala, Val, Gly, or Ile
  SITE (173)..(173): Xaa at position 173 is Ile, Ala, Val, Leu, or Gly
  SITE (176)..(176): Xaa at position 176 is Ala, Gly, or Pro
  SITE (177)..(177): Xaa at position 177 is Ile, Ala, Val, Leu, or Gly
  SITE (178)..(178): Xaa at position 178 is Ile, Ala, Val, Leu, or Gly
  SITE (190)..(190): Xaa at position 190 is Val, Ala, Gly, Leu, or Ile
  SITE (194)..(194): Xaa at position 194 is Ala, Gly, or Pro
  SITE (197)..(197): Xaa at position 197 is Ala, Gly, or Pro
  SITE (198)..(198): Xaa at position 198 is Leu, Ala, Val, Gly, or Ile
  SITE (202)..(202): Xaa at position 202 is Leu, Ala, Val, Gly, or Ile
  SITE (209)..(209): Xaa at position 209 is Phe, Tyr, Met, His, Ile, Leu, Val Ala, or Gly
  SITE (218)..(218): Xaa at position 218 is Ile, Ala, Val, Leu, or Gly
  SITE (219)..(219): Xaa at position 219 is Met, Ile, Leu, Val, Ala, or Gly
  SITE (221)..(221): Xaa at position 221 is Val, Ala, Gly, Leu, or Ile
  SITE (222)..(222): Xaa at position 222 is Val, Ala, Gly, Leu, or Ile
  SITE (233)..(233): Xaa at position 233 is Val, Ala, Gly, Leu, or Ile
  SITE (236)..(236): Xaa at position 236 is Ala, Gly, or Pro
  SITE (237)..(237): Xaa at position 237 is Ala, Gly, or Pro
  SITE (241)..(241): Xaa at position 241 is Leu, Ala, Val, Gly, or Ile
  SITE (244)..(244): Xaa at position 244 is Ile, Ala, Val, Leu, or Gly
  SITE (245)..(245): Xaa at position 245 is Met, Ile, Leu, Val, Ala, or Gly
  SITE (252)..(252): Xaa at position 252 is Met, Ile, Leu, Val, Ala, or Gly
  SITE (260)..(260): Xaa at position 260 is Leu, Ala, Val, Gly, or Ile
  SITE (267)..(267): Xaa at position 267 is Ala, Gly, or Pro
  SITE (268)..(268): Xaa at position 268 is Met, Ile, Leu, Val, Ala, or Gly
  SITE (275)..(275): Xaa at position 275 is Val, Ala, Gly, Leu, or Ile
  SITE (276)..(276): Xaa at position 276 is Ala, Gly, or Pro
  SITE (280)..(280): Xaa at position 280 is Ile, Ala, Val, Leu, or Gly
  SITE (282)..(282): Xaa at position 282 is Phe, Tyr, Met, His, Ile, Leu, Val Ala, or Gly
  SITE (283)..(283): Xaa at position 283 is Trp, Tyr, Phe, Met, His, Ile, Leu Val, Ala, or Gly
  SITE (286)..(286): Xaa at position 286 is Val, Ala, Gly, Leu, or Ile
  SITE (287)..(287): Xaa at position 287 is Cys, Ala, Val, Gly, Ser, or Thr
  SITE (300)..(300): Xaa at position 300 is Ala, Gly, or Pro
  SITE (301)..(301): Xaa at position 301 is Ala, Gly, or Pro
  SITE (315)..(315): Xaa at position 315 is Ala, Gly, or Pro
  SITE (318)..(318): Xaa at position 318 is Ala, Gly, or Pro
  SITE (319)..(319): Xaa at position 319 is Leu, Ala, Val, Gly, or Ile
  SITE (322)..(322): Xaa at position 322 is Leu, Ala, Val, Gly, or Ile
  SITE (323)..(323): Xaa at position 323 is Val, Ala, Gly, Leu, or Ile
  SITE (326)..(326): Xaa at position 326 is Leu, Ala, Val, Gly, or Ile
  SITE (330)..(330): Xaa at position 330 is Leu, Ala, Val, Gly, or Ile
  SITE (345)..(345): Xaa at position 345 is Cys, Ala, Val, Gly, Ser, or Thr
  SITE (347)..(347): Xaa at position 347 is Ala, Gly, or Pro
  SITE (348)..(348): Xaa at position 348 is Ala, Gly, or Pro
  SITE (351)..(351): Xaa at position 351 is Cys, Ala, Val, Gly, Ser, or Thr
  SITE (352)..(352): Xaa at position 352 is Leu, Ala, Val, Gly, or Ile
  SITE (355)..(355): Xaa at position 355 is Leu, Ala, Val, Gly, or Ile
  SITE (356)..(356): Xaa at position 356 is Ala, Gly, or Pro
  SITE (363)..(363): Xaa at position 363 is Ile, Ala, Val, Leu, or Gly
  SITE (367)..(367): Xaa at position 367 is Val, Ala, Gly, Leu, or Ile
  SITE (385)..(385): Xaa at position 385 is Ala, Gly, or Pro
  SITE (386)..(386): Xaa at position 386 is Ala, Gly, or Pro
  SITE (387)..(387): Xaa at position 387 is Val, Ala, Gly, Leu, or Ile
  SITE (389)..(389): Xaa at position 389 is Ala, Gly, or Pro
  SITE (392)..(392): Xaa at position 392 is Cys, Ala, Val, Gly, Ser, or Thr
  SITE (393)..(393): Xaa at position 393 is Ile, Ala, Val, Leu, or Gly
  SITE (394)..(394): Xaa at position 394 is Leu, Ala, Val, Gly, or Ile
  SITE (402)..(402): Xaa at position 402 is Leu, Ala, Val, Gly, or Ile
  SITE (406)..(406): Xaa at position 406 is Val, Ala, Gly, Leu, or Ile
  SITE (413)..(413): Xaa at position 413 is Leu, Ala, Val, Gly, or Ile
  SITE (424)..(424): Xaa at position 424 is Val, Ala, Gly, Leu, or Ile
  SITE (428)..(428): Xaa at position 428 is Ala, Gly, or Pro
  SITE (429)..(429): Xaa at position 429 is Ala, Gly, or Pro
  SITE (432)..(432): Xaa at position 432 is Val, Ala, Gly, Leu, or Ile
  SITE (435)..(435): Xaa at position 435 is Ile, Ala, Val, Leu, or Gly
  SITE (436)..(436): Xaa at position 436 is Cys, Ala, Val, Gly, Ser, or Thr
  SITE (439)..(439): Xaa at position 439 is Leu, Ala, Val, Gly, or Ile
  SITE (442)..(442): Xaa at position 442 is Ala, Gly, or Pro
  SITE (443)..(443): Xaa at position 443 is Ala, Gly, or Pro
  SITE (452)..(452): Xaa at position 452 is Leu, Ala, Val, Gly, or Ile
  SITE (455)..(455): Xaa at position 455 is Cys, Ala, Val, Gly, Ser, or Thr
  SITE (456)..(456): Xaa at position 456 is Leu, Ala, Val, Gly, or Ile
  SITE (460)..(460): Xaa at position 460 is Leu, Ala, Val, Gly, or Ile
  SITE (467)..(467): Xaa at position 467 is Ala, Gly, or Pro
  SITE (470)..(470): Xaa at position 470 is Val, Ala, Gly, Leu, or Ile
  SITE (471)..(471): Xaa at position 471 is Cys, Ala, Val, Gly, Ser, or Thr
  SITE (473)..(473): Xaa at position 473 is Ala, Gly, or Pro
  SITE (474)..(474): Xaa at position 474 is Phe, Tyr, Met, His, Ile, Leu, Val Ala, or Gly
  SITE (477)..(477): Xaa at position 477 is Leu, Ala, Val, Gly, or Ile
  SITE (478)..(478): Xaa at position 478 is Ala, Gly, or Pro
  SITE (481)..(481): Xaa at position 481 is Ala, Gly, or Pro
  SITE (499)..(499): Xaa at position 499 is Leu, Ala, Val, Gly, or Ile
  SITE (503)..(503): Xaa at position 503 is Phe, Tyr, Met, His, Ile, Leu, Val Ala, or Gly
  SITE (506)..(506): Xaa at position 506 is Ile, Ala, Val, Leu, or Gly
  SITE (507)..(507): Xaa at position 507 is Val, Ala, Gly, Leu, or Ile
  SITE (510)..(510): Xaa at position 510 is Leu, Ala, Val, Gly, or Ile
  SITE (524)..(524): Xaa at position 524 is Leu, Ala, Val, Gly, or Ile
  SITE (528)..(528): Xaa at position 528 is Ala, Gly, or Pro
  SITE (529)..(529): Xaa at position 529 is Tyr, Phe, Met, His, Ile, Leu, Val Ala, or Gly
  SITE (532)..(532): Xaa at position 532 is Leu, Ala, Val, Gly, or Ile
  SITE (533)..(533): Xaa at position 533 is Met, Ile, Leu, Val, Ala, or Gly
  SITE (535)..(535): Xaa at position 535 is Ile, Ala, Val, Leu, or Gly
  SITE (536)..(536): Xaa at position 536 is Val, Ala, Gly, Leu, or Ile
  SITE (540)..(540): Xaa at position 540 is Ala, Gly, or Pro
  SITE (543)..(543): Xaa at position 543 is Cys, Ala, Val, Gly, Ser, or Thr
  SITE (546)..(546): Xaa at position 546 is Ala, Gly, or Pro
  SITE (547)..(547): Xaa at position 547 is Val, Ala, Gly, Leu, or Ile
  SITE (554)..(554): Xaa at position 554 is Ile, Ala, Val, Leu, or Gly
  SITE (558)..(558): Xaa at position 558 is Leu, Ala, Val, Gly, or Ile
  SITE (561)..(561): Xaa at position 561 is Val, Ala, Gly, Leu, or Ile
  SITE (562)..(562): Xaa at position 562 is Leu, Ala, Val, Gly, or Ile
  SITE (584)..(584): Xaa at position 584 is Leu, Ala, Val, Gly, or Ile
  SITE (585)..(585): Xaa at position 585 is Cys, Ala, Val, Gly, Ser, or Thr
  SITE (588)..(588): Xaa at position 588 is Leu, Ala, Val, Gly, or Ile
  SITE (591)..(591): Xaa at position 591 is Val, Ala, Gly, Leu, or Ile
  SITE (592)..(592): Xaa at position 592 is Leu, Ala, Val, Gly, or Ile
  SITE (595)..(595): Xaa at position 595 is Val, Ala, Gly, Leu, or Ile
  SITE (600)..(600): Xaa at position 600 is Ala, Gly, or Pro
  SITE (603)..(603): Xaa at position 603 is Ile, Ala, Val, Leu, or Gly
  SITE (607)..(607): Xaa at position 607 is Val, Ala, Gly, Leu, or Ile
  SITE (608)..(608): Xaa at position 608 is Met, Ile, Leu, Val, Ala, or Gly
  SITE (611)..(611): Xaa at position 611 is Leu, Ala, Val, Gly, or Ile
  SITE (614)..(614): Xaa at position 614 is Met, Ile, Leu, Val, Ala, or Gly
  SITE (615)..(615): Xaa at position 615 is Phe, Tyr, Met, His, Ile, Leu, Val Ala, or Gly
  SITE (624)..(624): Xaa at position 624 is Val, Ala, Gly, Leu, or Ile
  SITE (628)..(628): Xaa at position 628 is Ala, Gly, or Pro
  SITE (629)..(629): Xaa at position 629 is Leu, Ala, Val, Gly, or Ile
  SITE (631)..(631): Xaa at position 631 is Ala, Gly, or Pro
  SITE (632)..(632): Xaa at position 632 is Val, Ala, Gly, Leu, or Ile
  SITE (635)..(635): Xaa at position 635 is Leu, Ala, Val, Gly, or Ile
  SITE (636)..(636): Xaa at position 636 is Val, Ala, Gly, Leu, or Ile
  SITE (639)..(639): Xaa at position 639 is Leu, Ala, Val, Gly, or Ile
  SITE (643)..(643): Xaa at position 643 is Phe, Tyr, Met, His, Ile, Leu, Val Ala, or Gly
  SITE (647)..(647): Xaa at position 647 is Met, Ile, Leu, Val, Ala, or Gly
  SITE (650)..(650): Xaa at position 650 is Phe, Tyr, Met, His, Ile, Leu, Val Ala, or Gly
  SITE (658)..(658): Xaa at position 658 is Leu, Ala, Val, Gly, or Ile
  SITE (666)..(666): Xaa at position 666 is Val, Ala, Gly, Leu, or Ile
  SITE (667)..(667): Xaa at position 667 is Cys, Ala, Val, Gly, Ser, or Thr
  SITE (670)..(670): Xaa at position 670 is Ala, Gly, or Pro
  SITE (671)..(671): Xaa at position 671 is Val, Ala, Gly, Leu, or Ile
  SITE (673)..(673): Xaa at position 673 is Leu, Ala, Val, Gly, or Ile
  SITE (674)..(674): Xaa at position 674 is Val, Ala, Gly, Leu, or Ile
  SITE (677)..(677): Xaa at position 677 is Leu, Ala, Val, Gly, or Ile
  SITE (678)..(678): Xaa at position 678 is Cys, Ala, Val, Gly, Ser, or Thr
  SITE (681)..(681): Xaa at position 681 is Leu, Ala, Val, Gly, or Ile
  SITE (693)..(693): Xaa at position 693 is Met, Ile, Leu, Val, Ala, or Gly
  SITE (696)..(696): Xaa at position 696 is Leu, Ala, Val, Gly, or Ile
  SITE (709)..(709): Xaa at position 709 is Val, Ala, Gly, Leu, or Ile
  SITE (713)..(713): Xaa at position 713 is Ile, Ala, Val, Leu, or Gly
  SITE (714)..(714): Xaa at position 714 is Leu, Ala, Val, Gly, or Ile
  SITE (716)..(716): Xaa at position 716 is Val, Ala, Gly, Leu, or Ile
  SITE (717)..(717): Xaa at position 717 is Phe, Tyr, Met, His, Ile, Leu, Val Ala, or Gly
  SITE (720)..(720): Xaa at position 720 is Ile, Ala, Val, Leu, or Gly
  SITE (721)..(721): Xaa at position 721 is Ala, Gly, or Pro
  SITE (728)..(728): Xaa at position 728 is Phe, Tyr, Met, His, Ile, Leu, Val Ala, or Gly
  SITE (735)..(735): Xaa at position 735 is Val, Ala, Gly, Leu, or Ile
  SITE (736)..(736): Xaa at position 736 is Leu, Ala, Val, Gly, or Ile
  SITE (739)..(739): Xaa at position 739 is Leu, Ala, Val, Gly, or Ile
  SITE (742)..(742): Xaa at position 742 is Ala, Gly, or Pro
  SITE (758)..(758): Xaa at position 758 is Leu, Ala, Val, Gly, or Ile
  SITE (765)..(765): Xaa at position 765 is Cys, Ala, Val, Gly, Ser, or Thr
  SITE (766)..(766): Xaa at position 766 is Leu, Ala, Val, Gly, or Ile
  SITE (768)..(768): Xaa at position 768 is Ala, Gly, or Pro
  SITE (769)..(769): Xaa at position 769 is Tyr, Phe, Met, His, Ile, Leu, Val Ala, or Gly
  SITE (772)..(772): Xaa at position 772 is Ile, Ala, Val, Leu, or Gly
  SITE (773)..(773): Xaa at position 773 is Val, Ala, Gly, Leu, or Ile
  SITE (776)..(776): Xaa at position 776 is Leu, Ala, Val, Gly, or Ile
  SITE (787)..(787): Xaa at position 787 is Val, Ala, Gly, Leu, or Ile
  SITE (790)..(790): Xaa at position 790 is Val, Ala, Gly, Leu, or Ile
  SITE (794)..(794): Xaa at position 794 is Val, Ala, Gly, Leu, or Ile
  SITE (797)..(797): Xaa at position 797 is Ile, Ala, Val, Leu, or Gly
  SITE (798)..(798): Xaa at position 798 is Leu, Ala, Val, Gly, or Ile
  SITE (800)..(800): Xaa at position 800 is Phe, Tyr, Met, His, Ile, Leu, Val Ala, or Gly
  SITE (801)..(801): Xaa at position 801 is Ile, Ala, Val, Leu, or Gly
  SITE (804)..(804): Xaa at position 804 is Ile, Ala, Val, Leu, or Gly
  SITE (814)..(814): Xaa at position 814 is Val, Ala, Gly, Leu, or Ile
  SITE (815)..(815): Xaa at position 815 is Val, Ala, Gly, Leu, or Ile
  SITE (816)..(816): Xaa at position 816 is Ala, Gly, or Pro
  SITE (818)..(818): Xaa at position 818 is Ala, Gly, or Pro
  SITE (819)..(819): Xaa at position 819 is Ala, Gly, or Pro
  SITE (821)..(821): Xaa at position 821 is Leu, Ala, Val, Gly, or Ile
  SITE (822)..(822): Xaa at position 822 is Ile, Ala, Val, Leu, or Gly
  SITE (825)..(825): Xaa at position 825 is Leu, Ala, Val, Gly, or Ile
  SITE (828)..(828): Xaa at position 828 is Ala, Gly, or Pro
  SITE (833)..(833): Xaa at position 833 is Val, Ala, Gly, Leu, or Ile
  SITE (837)..(837): Xaa at position 837 is Val, Ala, Gly, Leu, or Ile
  SITE (843)..(843): Xaa at position 843 is Ile, Ala, Val, Leu, or Gly
  SITE (846)..(846): Xaa at position 846 is Leu, Ala, Val, Gly, or Ile
  SITE (847)..(847): Xaa at position 847 is Leu, Ala, Val, Gly, or Ile
  SITE (858)..(858): Xaa at position 858 is Ala, Gly, or Pro
  SITE (861)..(861): Xaa at position 861 is Leu, Ala, Val, Gly, or Ile
  SITE (862)..(862): Xaa at position 862 is Ala, Gly, or Pro
  SITE (865)..(865): Xaa at position 865 is Ala, Gly, or Pro
MELITXXEKTVSPDRLELEAXQKFXERAAVENLPTFLVEXSRVXANPGNSQVXRVXXGXQXKNSXTSKDPDIKAQYQQRXLAIDANARREXKNYXLQTLGTETYRPSSXSQXXXGXXCAEIPVNQWPEXIPQXVANXTNPNSTEHMKESTXEXIGYXCQDXDPEQXQDKSNEXLTXXXQGMRKEEPSNNXKLAXTNXXLNSXEFTKANXDKESERHFXXQXXCEATQCPDTRXRVXXLQNXVKXXSLYYQYXETYMGPAXFAITIEXXKSDIDEXXLQGXEXXSNXXDEEMDLAIEASEXXEQGRPPEHTSKFYXKGXXQYXXPIXTQTXTKQDENDDDDDWNPXKXXGVXXMLXXTCCEDDXVPHXLPFIKEHIKNPDWRYRDXXXMXFGXXXEGPEPSQXKPLXIQAMPTXIELMKDPSVVXRDTXXWTXGRXXELXPEXXINDVYLAPXLQXXIEGXSAEPRVXSNXXWXXSSXXEAXYEAADVADDQEEPATYCXSSSXELXXQKXLETTDRPDGHQNNXRSSXXESXXEXXKNSXKDXYPXXQKTTLVXMERXQQXXQMESHIQSTSDRIQFNDLQSLXXATXQNXXRKXQHQDXLQXSDVXXASXLRXXQSTAGSGGXQEDXXMXXSTXXEVXGGEXLKYXEAXKPFLGIGXKNYAEYQXXLAXXGXXGDXXRAXQSNIIPFCDEVXQLXLENLGNENVHRSXKPQXXSXXGDXXLAIGGEXKKYLEVXXNTXQQXSQAQVDKSDYDMVDYXNELRESXXEXXTGXXQGXKGDQENVHPDXMLXQPRXEFXXSXXDHXAGDEDHTDGXXXCXXGXXGDXCTXFGKDXLKLXEARPMXHEXXTEGRRSKTNKXKTXXTWXTKELRKLKNQA

SEQ ID NO: 706 - protein, 740 aa, Homo sapiens
  SITE (411)..(411): Xaa at position 411 is Val, Ala, Gly, Leu, or Ile
  SITE (421)..(421): Xaa at position 421 is Cys, Ala, Val, Gly, Ser, or Thr
  SITE (423)..(423): Xaa at position 423 is Cys, Ala, Val, Gly, Ser, or Thr
  SITE (431)..(431): Xaa at position 431 is Ala, Gly, or Pro
  SITE (437)..(437): Xaa at position 437 is Val, Ala, Gly, Leu, or Ile
  SITE (439)..(439): Xaa at position 439 is Leu, Ala, Val, Gly, or Ile
  SITE (443)..(443): Xaa at position 443 is Cys, Ala, Val, Gly, Ser, or Thr
  SITE (447)..(447): Xaa at position 447 is His, Phe, Tyr, Lys, Arg, Gly, Ser Thr, Ala, Val, Leu, Ile, Asn, Met, or Gln
  SITE (472)..(472): Xaa at position 472 is Leu, Ala, Val, Gly, or Ile
  SITE (473)..(473): Xaa at position 473 is Met, Ile, Leu, Val, Ala, or Gly
  SITE (481)..(481): Xaa at position 481 is Ile, Ala, Val, Leu, or Gly
  SITE (484)..(484): Xaa at position 484 is Ile, Ala, Val, Leu, or Gly
  SITE (510)..(510): Xaa at position 510 is Ile, Ala, Val, Leu, or Gly
  SITE (575)..(575): Xaa at position 575 is Leu, Ala, Val, Gly, or Ile
  SITE (588)..(588): Xaa at position 588 is Met, Ile, Leu, Val, Ala, or Gly
  SITE (591)..(591): Xaa at position 591 is Ala, Gly, or Pro
  SITE (593)..(593): Xaa at position 593 is Ala, Gly, or Pro
  SITE (614)..(614): Xaa at position 614 is Ala, Gly, or Pro
  SITE (622)..(622): Xaa at position 622 is Ala, Gly, or Pro
  SITE (623)..(623): Xaa at position 623 is Cys, Ala, Val, Gly, Ser, or Thr
  SITE (626)..(626): Xaa at position 626 is Leu, Ala, Val, Gly, or Ile
  SITE (647)..(647): Xaa at position 647 is Ala, Gly, or Pro
  SITE (655)..(655): Xaa at position 655 is Leu, Ala, Val, Gly, or Ile
  SITE (656)..(656): Xaa at position 656 is Ala, Gly, or Pro
  SITE (659)..(659): Xaa at position 659 is Phe, Tyr, Met, His, Ile, Leu, Val Ala, or Gly
  SITE (680)..(680): Xaa at position 680 is Ala, Gly, or Pro
  SITE (688)..(688): Xaa at position 688 is Ile, Ala, Val, Leu, or Gly
  SITE (691)..(691): Xaa at position 691 is Leu, Ala, Val, Gly, or Ile
  SITE (713)..(713): Xaa at position 713 is Leu, Ala, Val, Gly, or Ile
MTVKLDFEECLKDSPRFRASIELVEAEVSELETRLEKLLKLGTGLLESGRHYLAASRAFVVGICDLARLGPPEPMMAECLEKFTVSLNHKLDSHAELLDATQHTLQQQIQTLVKEGLRGFREARRDFWRGAESLEAALTHNAEVPRRRAQEAEEAGAALRTARAGYRGRALDYALQINVIEDKRKFDIMEFVLRLVEAQATHFQQGHEELSRLSQYRKELGAQLHQLVLNSAREKRDMEQRHVLLKQKELGGEEPEPSLREGPGGLVMEGHLFKRASNAFKTWSRRWFTIQSNQLVYQKKYKDPVTVVVDDLRLCTVKLCPDSERRFCFEVVSTSKSCLLQADSERLLQLWVSAVQSSIASAFSQARLDDSPRGPGQGSGHLAIGSAATLGSGGMARGREPGGVGHVVAQXQSVDGNAQCXDXREPAPEWXSINLGXTXCIQXSGIXRSLGVHFSKVRSLTLDSWEPELVKXXCELGNVIXNQXYEARVEAMAVKKPGPSCSRQEKEAWXHAKYVEKKFLTKLPEIRGRRGGRGRPRGQPPVPPKPSIRPRPGSLRSKPEPPSEDLGSLHPGALXFRASGHPPSLPTXADXLXHGADVNWVNGGQDNATPLIQXTAANSLLXXEFXLQNGANVNQADSAGRGPLHHXTILGHTGXXCLXLKRGADLGARDSEGRDPLTIXMETANADXVTXLRLAKMREAEAAQGQAGDETYXDIFRDFSLMASDDPEKLSRRSHDLHTL

SEQ ID NO: 707 - protein, 597 aa, Homo sapiens
  SITE (84)..(84): Xaa at position 84 is Ile, Ala, Val, Leu, or Gly
  SITE (105)..(105): Xaa at position 105 is Leu, Ala, Val, Gly, or Ile
  SITE (108)..(108): Xaa at position 108 is Phe, Tyr, Met, His, Ile, Leu, Val Ala, or Gly
  SITE (128)..(128): Xaa at position 128 is Val, Ala, Gly, Leu, or Ile
  SITE (132)..(132): Xaa at position 132 is Ile, Ala, Val, Leu, or Gly
  SITE (145)..(145): Xaa at position 145 is Tyr, Phe, Met, His, Ile, Leu, Val Ala, or Gly
  SITE (147)..(147): Xaa at position 147 is Leu, Ala, Val, Gly, or Ile
  SITE (154)..(154): Xaa at position 154 is Leu, Ala, Val, Gly, or Ile
  SITE (156)..(156): Xaa at position 156 is Val, Ala, Gly, Leu, or Ile
  SITE (158)..(158): Xaa at position 158 is Ala, Gly, or Pro
  SITE (176)..(176): Xaa at position 176 is Leu, Ala, Val, Gly, or Ile
  SITE (182)..(182): Xaa at position 182 is Ile, Ala, Val, Leu, or Gly
  SITE (184)..(184): Xaa at position 184 is Val, Ala, Gly, Leu, or Ile
  SITE (198)..(198): Xaa at position 198 is Ile, Ala, Val, Leu, or Gly
  SITE (199)..(199): Xaa at position 199 is Ile, Ala, Val, Leu, or Gly
  SITE (232)..(232): Xaa at position 232 is Leu, Ala, Val, Gly, or Ile
  SITE (240)..(240): Xaa at position 240 is Val, Ala, Gly, Leu, or Ile
  SITE (250)..(250): Xaa at position 250 is Ile, Ala, Val, Leu, or Gly
  SITE (254)..(254): Xaa at position 254 is Ile, Ala, Val, Leu, or Gly
  SITE (258)..(258): Xaa at position 258 is Leu, Ala, Val, Gly, or Ile
  SITE (263)..(263): Xaa at position 263 is Phe, Tyr, Met, His, Ile, Leu, Val Ala, or Gly
  SITE (266)..(266): Xaa at position 266 is Ile, Ala, Val, Leu, or Gly
  SITE (274)..(274): Xaa at position 274 is Ile, Ala, Val, Leu, or Gly
  SITE (298)..(298): Xaa at position 298 is Ile, Ala, Val, Leu, or Gly
  SITE (304)..(304): Xaa at position 304 is His, Phe, Tyr, Lys, Arg, Gly, Ser Thr, Ala, Val, Leu, Ile, Asn, Met, or Gln
  SITE (308)..(308): Xaa at position 308 is Val, Ala, Gly, Leu, or Ile
  SITE (315)..(315): Xaa at position 315 is Val, Ala, Gly, Leu, or Ile
  SITE (316)..(316): Xaa at position 316 is Tyr, Phe, Met, His, Ile, Leu, Val Ala, or Gly
  SITE (318)..(318): Xaa at position 318 is Ile, Ala, Val, Leu, or Gly
  SITE (338)..(338): Xaa at position 338 is Cys, Ala, Val, Gly, Ser, or Thr
  SITE (340)..(340): Xaa at position 340 is Phe, Tyr, Met, His, Ile, Leu, Val Ala, or Gly
  SITE (350)..(350): Xaa at position 350 is Leu, Ala, Val, Gly, or Ile
  SITE (357)..(357): Xaa at position 357 is Met, Ile, Leu, Val, Ala, or Gly
  SITE (358)..(358): Xaa at position 358 is Val, Ala, Gly, Leu, or Ile
  SITE (361)..(361): Xaa at position 361 is Met, Ile, Leu, Val, Ala, or Gly
  SITE (362)..(362): Xaa at position 362 is Val, Ala, Gly, Leu, or Ile
  SITE (385)..(385): Xaa at position 385 is Val, Ala, Gly, Leu, or Ile
  SITE (387)..(387): Xaa at position 387 is Phe, Tyr, Met, His, Ile, Leu, Val Ala, or Gly
  SITE (391)..(391): Xaa at position 391 is Phe, Tyr, Met, His, Ile, Leu, Val Ala, or Gly
  SITE (394)..(394): Xaa at position 394 is Ile, Ala, Val, Leu, or Gly
  SITE (396)..(396): Xaa at position 396 is Met, Ile, Leu, Val, Ala, or Gly
  SITE (397)..(397): Xaa at position 397 is Val, Ala, Gly, Leu, or Ile
  SITE (400)..(400): Xaa at position 400 is Leu, Ala, Val, Gly, or Ile
  SITE (414)..(414): Xaa at position 414 is Phe, Tyr, Met, His, Ile, Leu, Val Ala, or Gly
  SITE (423)..(423): Xaa at position 423 is Leu, Ala, Val, Gly, or Ile
  SITE (427)..(427): Xaa at position 427 is Cys, Ala, Val, Gly, Ser, or Thr
  SITE (443)..(443): Xaa at position 443 is Leu, Ala, Val, Gly, or Ile
  SITE (444)..(444): Xaa at position 444 is Leu, Ala, Val, Gly, or Ile
  SITE (447)..(447): Xaa at position 447 is Leu, Ala, Val, Gly, or Ile
  SITE (448)..(448): Xaa at position 448 is Val, Ala, Gly, Leu, or Ile
  SITE (452)..(452): Xaa at position 452 is Leu, Ala, Val, Gly, or Ile
  SITE (456)..(456): Xaa at position 456 is Cys, Ala, Val, Gly, Ser, or Thr
  SITE (461)..(461): Xaa at position 461 is Phe, Tyr, Met, His, Ile, Leu, Val Ala, or Gly
  SITE (462)..(462): Xaa at position 462 is Ile, Ala, Val, Leu, or Gly
  SITE (465)..(465): Xaa at position 465 is His, Phe, Tyr, Lys, Arg, Gly, Ser Thr, Ala, Val, Leu, Ile, Asn, Met, or Gln
  SITE (472)..(472): Xaa at position 472 is Leu, Ala, Val, Gly, or Ile
  SITE (473)..(473): Xaa at position 473 is Ala, Gly, or Pro
  SITE (486)..(486): Xaa at position 486 is Phe, Tyr, Met, His, Ile, Leu, Val Ala, or Gly
  SITE (488)..(488): Xaa at position 488 is Leu, Ala, Val, Gly, or Ile
  SITE (489)..(489): Xaa at position 489 is Phe, Tyr, Met, His, Ile, Leu, Val Ala, or Gly
  SITE (490)..(490): Xaa at position 490 is Val, Ala, Gly, Leu, or Ile
  SITE (491)..(491): Xaa at position 491 is Met, Ile, Leu, Val, Ala, or Gly
  SITE (496)..(496): Xaa at position 496 is Cys, Ala, Val, Gly, Ser, or Thr
  SITE (498)..(498): Xaa at position 498 is Ala, Gly, or Pro
  SITE (502)..(502): Xaa at position 502 is Leu, Ala, Val, Gly, or Ile
  SITE (511)..(511): Xaa at position 511 is Leu, Ala, Val, Gly, or Ile
  SITE (533)..(533): Xaa at position 533 is Phe, Tyr, Met, His, Ile, Leu, Val Ala, or Gly
  SITE (534)..(534): Xaa at position 534 is Cys, Ala, Val, Gly, Ser, or Thr
  SITE (545)..(545): Xaa at position 545 is Ala, Gly, or Pro
  SITE (547)..(547): Xaa at position 547 is Trp, Tyr, Phe, Met, His, Ile, Leu Val, Ala, or Gly
  SITE (549)..(549): Xaa at position 549 is Met, Ile, Leu, Val, Ala, or Gly
  SITE (551)..(551): Xaa at position 551 is Ile, Ala, Val, Leu, or Gly
  SITE (554)..(554): Xaa at position 554 is Val, Ala, Gly, Leu, or Ile
  SITE (555)..(555): Xaa at position 555 is Ala, Gly, or Pro
  SITE (556)..(556): Xaa at position 556 is Met, Ile, Leu, Val, Ala, or Gly
  SITE (557)..(557): Xaa at position 557 is Phe, Tyr, Met, His, Ile, Leu, Val Ala, or Gly
  SITE (567)..(567): Xaa at position 567 is Val, Ala, Gly, Leu, or Ile
MAAVQAAEVKVDGSEPKLSKNELKRRLKAEKKVAEKEAKQKELSEKQLSQATAAATNHTTDNGVGPEEESVDPNQYYKIRSQAXHQLKVNGEDPYPHKFHVDISXTDXIQKYSHLQPGDHLTDITLKXAGRXHAKRASGGKLIFXDXRGEGVKXQXMXNSRNYKSEEEFIHINNKXRRGDIXGXQGNPGKTKKGELSXXPYEITLLSPCLHMLPHLHFGLKDKETRYRQRYXDLILNDFXRQKFIIRSKXITYXRSFXDELGXLEXETPMMNIXPGGAVAKPFITYHNELDMNLYMRXAPELYXKMLXVGGIDRXXEXGRQFRNEGIDLTHNPEFTTXEXYMAYADYHDXMEITEKXXSGXXKHITGSYKVTYHPDGPEGQAYDXDXTPPXRRXNXXEEXEKALGMKLPETNLXETEETRKIXDDIXVAKAVECPPPRTTARXXDKXXGEFXEVTXINPTXXCDXPQIMSPXXKWHRSKEGLTERXEXXXXKKEIXNXYTEXNDPMRQRQXFEEQAKAKAAGDDEAMFIDENXXTALEYGLPPTXGXGXGXDRXXXXLTDSNNIKEXLLFPAMKPEDKKENVATTDTLESTTVGTSV

SEQ ID NO: 708 - protein, 404 aa, Homo sapiens
  SITE (36)..(36): Xaa at position 36 is Leu, Ala, Val, Gly, or Ile
  SITE (51)..(51): Xaa at position 51 is Trp, Tyr, Phe, Met, His, Ile, Leu Val, Ala, or Gly
  SITE (53)..(53): Xaa at position 53 is Leu, Ala, Val, Gly, or Ile
  SITE (72)..(72): Xaa at position 72 is Trp, Tyr, Phe, Met, His, Ile, Leu Val, Ala, or Gly
  SITE (76)..(76): Xaa at position 76 is Ala, Gly, or Pro
  SITE (84)..(84): Xaa at position 84 is Leu, Ala, Val, Gly, or Ile
  SITE (86)..(86): Xaa at position 86 is Leu, Ala, Val, Gly, or Ile
  SITE (89)..(89): Xaa at position 89 is Val, Ala, Gly, Leu, or Ile
  SITE (97)..(97): Xaa at position 97 is Phe, Tyr, Met, His, Ile, Leu, Val Ala, or Gly
  SITE (99)..(99): Xaa at position 99 is Cys, Ala, Val, Gly, Ser, or Thr
  SITE (101)..(101): Xaa at position 101 is Ala, Gly, or Pro
  SITE (115)..(115): Xaa at position 115 is Val, Ala, Gly, Leu, or Ile
  SITE (117)..(117): Xaa at position 117 is Val, Ala, Gly, Leu, or Ile
  SITE (133)..(133): Xaa at position 133 is Leu, Ala, Val, Gly, or Ile
  SITE (141)..(141): Xaa at position 141 is Val, Ala, Gly, Leu, or Ile
  SITE (144)..(144): Xaa at position 144 is Cys, Ala, Val, Gly, Ser, or Thr
  SITE (157)..(157): Xaa at position 157 is Trp, Tyr, Phe, Met, His, Ile, Leu Val, Ala, or Gly
  SITE (192)..(192): Xaa at position 192 is Leu, Ala, Val, Gly, or Ile
  SITE (208)..(208): Xaa at position 208 is Cys, Ala, Val, Gly, Ser, or Thr
  SITE (210)..(210): Xaa at position 210 is Phe, Tyr, Met, His, Ile, Leu, Val Ala, or Gly
  SITE (214)..(214): Xaa at position 214 is Leu, Ala, Val, Gly, or Ile
  SITE (238)..(238): Xaa at position 238 is Val, Ala, Gly, Leu, or Ile
  SITE (257)..(257): Xaa at position 257 is Leu, Ala, Val, Gly, or Ile
  SITE (271)..(271): Xaa at position 271 is Trp, Tyr, Phe, Met, His, Ile, Leu Val, Ala, or Gly
  SITE (301)..(301): Xaa at position 301 is Cys, Ala, Val, Gly, Ser, or Thr
MAAGTAVGAWVLVLSLWGAVVGAQNITARIGEPLVXKCKGAPKKPPQRLEXKXNTGRTEAWKVLSPQGGGPXDSVXRVLPNGSXFXPAXGIQDEGIXRXQXMNRNGKETKSNYRXRXYQIPGKPEIVDSASEXTAGVPNKXGTXVSEGSYPAGTLSXHLDGKPLVPNEKGVSVKEQTRRHPETGLFTLQSEXMVTPARGGDPRPTFSXSXSPGXPRHRALRTAPIQPRVWEPVPLEEXQLVVEPEGGAVAPGGTVTXTCEVPAQPSPQIHXMKDGVPLPLPPSPVLILPEIGPQDQGTYSXVATHSSHGPQESRAVSISIIEPGEEGPTAGSVGGSGLGTLALALGILGGLGTAALLIGVILWQRRQRRGEERKAPENQEEEEERAELNQSEEPEAGESSTGGP

SEQ ID NO: 709 - protein, 288 aa, Homo sapiens
  SITE (50)..(50): Xaa at position 50 is Ala, Gly, or Pro
  SITE (52)..(52): Xaa at position 52 is Phe, Tyr, Met, His, Ile, Leu, Val Ala, or Gly
  SITE (54)..(54): Xaa at position 54 is Cys, Ala, Val, Gly, Ser, or Thr
  SITE (56)..(56): Xaa at position 56 is Phe, Tyr, Met, His, Ile, Leu, Val Ala, or Gly
  SITE (65)..(65): Xaa at position 65 is Leu, Ala, Val, Gly, or Ile
  SITE (67)..(67): Xaa at position 67 is Trp, Tyr, Phe, Met, His, Ile, Leu Val, Ala, or Gly
  SITE (80)..(80): Xaa at position 80 is Ala, Gly, or Pro
  SITE (81)..(81): Xaa at position 81 is Ala, Gly, or Pro
  SITE (106)..(106): Xaa at position 106 is Phe, Tyr, Met, His, Ile, Leu, Val Ala, or Gly
  SITE (108)..(108): Xaa at position 108 is Met, Ile, Leu, Val, Ala, or Gly
  SITE (110)..(110): Xaa at position 110 is Val, Ala, Gly, Leu, or Ile
  SITE (113)..(113): Xaa at position 113 is Ala, Gly, or Pro
  SITE (121)..(121): Xaa at position 121 is Tyr, Phe, Met, His, Ile, Leu, Val Ala, or Gly
  SITE (123)..(123): Xaa at position 123 is Cys, Ala, Val, Gly, Ser, or Thr
  SITE (125)..(125): Xaa at position 125 is Ala, Gly, or Pro
  SITE (140)..(140): Xaa at position 140 is Ala, Gly, or Pro
  SITE (142)..(142): Xaa at position 142 is Leu, Ala, Val, Gly, or Ile
  SITE (144)..(144): Xaa at position 144 is Val, Ala, Gly, Leu, or Ile
MQIPQAPWPVVWAVLQLGWRPGWFLDSPDRPWNPPTFSPALLVVTEGDNXTXTXSXSNTSESFVXNXYRMSPSNQTDKLXXFPEDRSQPGQDCRFRVTQLPNGRDXHXSXVRXRRNDSGTXLXGXISLAPKAQIKESLRXEXRXTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 710 - protein, 4684 aa, Homo sapiens
  SITE (185)..(185): Xaa at position 185 is Phe, Tyr, Met, His, Ile, Leu, Val Ala, or Gly
  SITE (188)..(188): Xaa at position 188 is Trp, Tyr, Phe, Met, His, Ile, Leu Val, Ala, or Gly
  SITE (189)..(189): Xaa at position 189 is Val, Ala, Gly, Leu, or Ile
  SITE (193)..(193): Xaa at position 193 is Leu, Ala, Val, Gly, or Ile
  SITE (196)..(196): Xaa at position 196 is Ala, Gly, or Pro
  SITE (203)..(203): Xaa at position 203 is Leu, Ala, Val, Gly, or Ile
  SITE (207)..(207): Xaa at position 207 is Leu, Ala, Val, Gly, or Ile
  SITE (213)..(213): Xaa at position 213 is Leu, Ala, Val, Gly, or Ile
  SITE (214)..(214): Xaa at position 214 is Ile, Ala, Val, Leu, or Gly
  SITE (216)..(216): Xaa at position 216 is Leu, Ala, Val, Gly, or Ile
  SITE (217)..(217): Xaa at position 217 is Leu, Ala, Val, Gly, or Ile
  SITE (240)..(240): Xaa at position 240 is Val, Ala, Gly, Leu, or Ile
  SITE (243)..(243): Xaa at position 243 is Ala, Gly, or Pro
  SITE (244)..(244): Xaa at position 244 is Leu, Ala, Val, Gly, or Ile
  SITE (247)..(247): Xaa at position 247 is Leu, Ala, Val, Gly, or Ile
  SITE (254)..(254): Xaa at position 254 is Leu, Ala, Val, Gly, or Ile
  SITE (262)..(262): Xaa at position 262 is Ile, Ala, Val, Leu, or Gly
  SITE (263)..(263): Xaa at position 263 is Ala, Gly, or Pro
  SITE (271)..(271): Xaa at position 271 is Leu, Ala, Val, Gly, or Ile
  SITE (273)..(273): Xaa at position 273 is Leu, Ala, Val, Gly, or Ile
  SITE (274)..(274): Xaa at position 274 is Ile, Ala, Val, Leu, or Gly
  SITE (277)..(277): Xaa at position 277 is Ile, Ala, Val, Leu, or Gly
  SITE (278)..(278): Xaa at position 278 is Ile, Ala, Val, Leu, or Gly
  SITE (283)..(283): Xaa at position 283 is Ile, Ala, Val, Leu, or Gly
  SITE (286)..(286): Xaa at position 286 is Ile, Ala, Val, Leu, or Gly
  SITE (301)..(301): Xaa at position 301 is Leu, Ala, Val, Gly, or Ile
  SITE (304)..(304): Xaa at position 304 is Trp, Tyr, Phe, Met, His, Ile, Leu Val, Ala, or Gly
  SITE (309)..(309): Xaa at position 309 is Val, Ala, Gly, Leu, or Ile
  SITE (317)..(317): Xaa at position 317 is Cys, Ala, Val, Gly, Ser, or Thr
  SITE (320)..(320): Xaa at position 320 is Phe, Tyr, Met, His, Ile, Leu, Val Ala, or Gly
  SITE (324)..(324): Xaa at position 324 is Trp, Tyr, Phe, Met, His, Ile, Leu Val, Ala, or Gly
  SITE (329)..(329): Xaa at position 329 is Leu, Ala, Val, Gly, or Ile
  SITE (330)..(330): Xaa at position 330 is Phe, Tyr, Met, His, Ile, Leu, Val Ala, or Gly
  SITE (332)..(332): Xaa at position 332 is Ala, Gly, or Pro
  SITE (333)..(333): Xaa at position 333 is Ile, Ala, Val, Leu, or Gly
  SITE (334)..(334): Xaa at position 334 is Ile, Ala, Val, Leu, or Gly
  SITE (341)..(341): Xaa at position 341 is Leu, Ala, Val, Gly, or Ile
  SITE (347)..(347): Xaa at position 347 is Val, Ala, Gly, Leu, or Ile
  SITE (353)..(353): Xaa at position 353 is Leu, Ala, Val, Gly, or Ile
  SITE (356)..(356): Xaa at position 356 is Leu, Ala, Val, Gly, or Ile
  SITE (359)..(359): Xaa at position 359 is Ala, Gly, or Pro
  SITE (360)..(360): Xaa at position 360 is Phe, Tyr, Met, His, Ile, Leu, Val Ala, or Gly
  SITE (363)..(363): Xaa at position 363 is Ala, Gly, or Pro
  SITE (369)..(369): Xaa at position 369 is Val, Ala, Gly, Leu, or Ile
  SITE (372)..(372): Xaa at position 372 is Leu, Ala, Val, Gly, or Ile
  SITE (373)..(373): Xaa at position 373 is Leu, Ala, Val, Gly, or Ile
  SITE (378)..(378): Xaa at position 378 is Val, Ala, Gly, Leu, or Ile
  SITE (388)..(388): Xaa at position 388 is Ile, Ala, Val, Leu, or Gly
  SITE (389)..(389): Xaa at position 389 is Ile, Ala, Val, Leu, or Gly
  SITE (391)..(391): Xaa at position 391 is Tyr, Phe, Met, His, Ile, Leu, Val Ala, or Gly
  SITE (392)..(392): Xaa at position 392 is Val, Ala, Gly, Leu, or Ile
  SITE (395)..(395): Xaa at position 395 is Leu, Ala, Val, Gly, or Ile
  SITE (396)..(396): Xaa at position 396 is Tyr, Phe, Met, His, Ile, Leu, Val Ala, or Gly
  SITE (421)..(421): Xaa at position 421 is Tyr, Phe, Met, His, Ile, Leu, Val Ala, or Gly
  SITE (425)..(425): Xaa at position 425 is Val, Ala, Gly, Leu, or Ile
  SITE (428)..(428): Xaa at position 428 is Leu, Ala, Val, Gly, or Ile
  SITE (432)..(432): Xaa at position 432 is Met, Ile, Leu, Val, Ala, or Gly
  SITE (451)..(451): Xaa at position 451 is Ile, Ala, Val, Leu, or Gly
  SITE (483)..(483): Xaa at position 483 is Leu, Ala, Val, Gly, or Ile
  SITE (503)..(503): Xaa at position 503 is Val, Ala, Gly, Leu, or Ile
  SITE (510)..(510): Xaa at position 510 is Leu, Ala, Val, Gly, or Ile
  SITE (521)..(521): Xaa at position 521 is Leu, Ala, Val, Gly, or Ile
  SITE (545)..(545): Xaa at position 545 is Cys, Ala, Val, Gly, Ser, or Thr
  SITE (549)..(549): Xaa at position 549 is Leu, Ala, Val, Gly, or Ile
  SITE (552)..(552): Xaa at position 552 is Ala, Gly, or Pro
  SITE (556)..(556): Xaa at position 556 is Leu, Ala, Val, Gly, or Ile
  SITE (575)..(575): Xaa at position 575 is Val, Ala, Gly, Leu, or Ile
  SITE (579)..(579): Xaa at position 579 is Leu, Ala, Val, Gly, or Ile
  SITE (582)..(582): Xaa at position 582 is Ala, Gly, or Pro
  SITE (589)..(589): Xaa at position 589 is Leu, Ala, Val, Gly, or Ile
  SITE (593)..(593): Xaa at position 593 is Val, Ala, Gly, Leu, or Ile
  SITE (596)..(596): Xaa at position 596 is Leu, Ala, Val, Gly, or Ile
  SITE (611)..(611): Xaa at position 611 is Val, Ala, Gly, Leu, or Ile
  SITE (618)..(618): Xaa at position 618 is Leu, Ala, Val, Gly, or Ile
  SITE (662)..(662): Xaa at position 662 is Leu, Ala, Val, Gly, or Ile
  SITE (665)..(665): Xaa at position 665 is Leu, Ala, Val, Gly, or Ile
  SITE (668)..(668): Xaa at position 668 is Trp, Tyr, Phe, Met, His, Ile, Leu Val, Ala, or Gly
  SITE (669)..(669): Xaa at position 669 is Val, Ala, Gly, Leu, or Ile
  SITE (688)..(688): Xaa at position 688 is Val, Ala, Gly, Leu, or Ile
  SITE (702)..(702): Xaa at position 702 is Ile, Ala, Val, Leu, or Gly
  SITE (705)..(705): Xaa at position 705 is Phe, Tyr, Met, His, Ile, Leu, Val Ala, or Gly
  SITE (712)..(712): Xaa at position 712 is Ala, Gly, or Pro
  SITE (727)..(727): Xaa at position 727 is Tyr, Phe, Met, His, Ile, Leu, Val Ala, or Gly
  SITE (731)..(731): Xaa at position 731 is Leu, Ala, Val, Gly, or Ile
  SITE (734)..(734): Xaa at position 734 is Leu, Ala, Val, Gly, or Ile
  SITE (741)..(741): Xaa at position 741 is Leu, Ala, Val, Gly, or Ile
  SITE (752)..(752): Xaa at position 752 is Leu, Ala, Val, Gly, or Ile
  SITE (755)..(755): Xaa at position 755 is Leu, Ala, Val, Gly, or Ile
  SITE (758)..(758): Xaa at position 758 is Phe, Tyr, Met, His, Ile, Leu, Val Ala, or Gly
  SITE (759)..(759): Xaa at position 759 is Val, Ala, Gly, Leu, or Ile
  SITE (762)..(762): Xaa at position 762 is Ala, Gly, or Pro
  SITE (769)..(769): Xaa at position 769 is Leu, Ala, Val, Gly, or Ile
  SITE (798)..(798): Xaa at position 798 is Leu, Ala, Val, Gly, or Ile
  SITE (826)..(826): Xaa at position 826 is Ala, Gly, or Pro
  SITE (830)..(830): Xaa at position 830 is Val, Ala, Gly, Leu, or Ile
  SITE (837)..(837): Xaa at position 837 is Leu, Ala, Val, Gly, or Ile
  SITE (844)..(844): Xaa at position 844 is Met, Ile, Leu, Val, Ala, or Gly
  SITE (847)..(847): Xaa at position 847 is Leu, Ala, Val, Gly, or Ile
  SITE (850)..(850): Xaa at position 850 is Cys, Ala, Val, Gly, Ser, or Thr
  SITE (851)..(851): Xaa at position 851 is Ile, Ala, Val, Leu, or Gly
  SITE (854)..(854): Xaa at position 854 is His, Phe, Tyr, Lys, Arg, Gly, Ser Thr, Ala, Val, Leu, Ile, Asn, Met, or Gln
  SITE (864)..(864): Xaa at position 864 is Phe, Tyr, Met, His, Ile, Leu, Val Ala, or Gly
  SITE (871)..(871): Xaa at position 871 is Ala, Gly, or Pro
  SITE (875)..(875): Xaa at position 875 is Leu, Ala, Val, Gly, or Ile
  SITE (918)..(918): Xaa at position 918 is Leu, Ala, Val, Gly, or Ile
  SITE (921)..(921): Xaa at position 921 is Leu, Ala, Val, Gly, or Ile
  SITE (925)..(925): Xaa at position 925 is Ala, Gly, or Pro
  SITE (931)..(931): Xaa at position 931 is Leu, Ala, Val, Gly, or Ile
  SITE (946)..(946): Xaa at position 946 is Leu, Ala, Val, Gly, or Ile
  SITE (950)..(950): Xaa at position 950 is Cys, Ala, Val, Gly, Ser, or Thr
  SITE (988)..(988): Xaa at position 988 is Val, Ala, Gly, Leu, or Ile
  SITE (991)..(991): Xaa at position 991 is Val, Ala, Gly, Leu, or Ile
  SITE (992)..(992): Xaa at position 992 is Cys, Ala, Val, Gly, Ser, or Thr
  SITE (993)..(993): Xaa at position 993 is Phe, Tyr, Met, His, Ile, Leu, Val Ala, or Gly
  SITE (995)..(995): Xaa at position 995 is Val, Ala, Gly, Leu, or Ile
  SITE (1002)..(1002): Xaa at position 1002 is Ala, Gly, or Pro
  SITE (1006)..(1006): Xaa at position 1006 is Val, Ala, Gly, Leu, or Ile
  SITE (1009)..(1009): Xaa at position 1009 is Leu, Ala, Val, Gly, or Ile
  SITE (4418)..(4418): Xaa at position 4418 is Ala, Gly, or Pro
  SITE (4420)..(4420): Xaa at position 4420 is Ile, Ala, Val, Leu, or Gly
  SITE (4431)..(4431): Xaa at position 4431 is Ile, Ala, Val, Leu, or Gly
  SITE (4434)..(4434): Xaa at position 4434 is Ala, Gly, or Pro
  SITE (4448)..(4448): Xaa at position 4448 is Leu, Ala, Val, Gly, or Ile
  SITE (4449)..(4449): Xaa at position 4449 is Leu, Ala, Val, Gly, or Ile
  SITE (4453)..(4453): Xaa at position 4453 is Ala, Gly, or Pro
  SITE (4454)..(4454): Xaa at position 4454 is Cys, Ala, Val, Gly, Ser, or Thr
  SITE (4458)..(4458): Xaa at position 4458 is Ile, Ala, Val, Leu, or Gly
  SITE (4459)..(4459): Xaa at position 4459 is Ile, Ala, Val, Leu, or Gly
  SITE (4469)..(4469): Xaa at position 4469 is Val, Ala, Gly, Leu, or Ile
  SITE (4472)..(4472): Xaa at position 4472 is Ala, Gly, or Pro
  SITE (4486)..(4486): Xaa at position 4486 is Ile, Ala, Val, Leu, or Gly
  SITE (4489)..(4489): Xaa at position 4489 is Ala, Gly, or Pro
  SITE (4492)..(4492): Xaa at position 4492 is Ala, Gly, or Pro
  SITE (4507)..(4507): Xaa at position 4507 is Ala, Gly, or Pro
  SITE (4508)..(4508): Xaa at position 4508 is Ala, Gly, or Pro
  SITE (4510)..(4510): Xaa at position 4510 is Ala, Gly, or Pro
  SITE (4520)..(4520): Xaa at position 4520 is Ala, Gly, or Pro
  SITE (4524)..(4524): Xaa at position 4524 is Phe, Tyr, Met, His, Ile, Leu Val, Ala, or Gly
  SITE (4525)..(4525): Xaa at position 4525 is Leu, Ala, Val, Gly, or Ile
  SITE (4548)..(4548): Xaa at position 4548 is Ala, Gly, or Pro
  SITE (4562)..(4562): Xaa at position 4562 is Leu, Ala, Val, Gly, or Ile
  SITE (4567)..(4567): Xaa at position 4567 is Ala, Gly, or Pro
  SITE (4572)..(4572): Xaa at position 4572 is Leu, Ala, Val, Gly, or Ile
  SITE (4586)..(4586): Xaa at position 4586 is Ala, Gly, or Pro
  SITE (4600)..(4600): Xaa at position 4600 is Leu, Ala, Val, Gly, or Ile
  SITE (4603)..(4603): Xaa at position 4603 is Ala, Gly, or Pro
MVAGMLMPRDQLRAIYEVLFREGVMVAKKDRRPRSLHPHVPGVTNLQVMRAMASLRARGLVRETFAWCHFYWYLTNEGIAHLRQYLHLPPEIVPASLQRVRRPVAMVMPARRTPHVQAVQGPLGSPPKRGPLPTEEQRVYRRKELEEVSPETPVVPATTQRTLARPGPEPAPATDERDRVQKKTXTKXXNKHXIKXQRHISDXYEDXRDGHNXXSXXEVLSGDSLPREKGRMRFHKLQNXQIXXDYXRHRQVKXVNIRNDDXXDGNPKLTXGXXWTXXLHFQXSDXQVSGQSEDMTAKEKXLLXSQRMXEGYQGLRXDNXTSSXRDGRXXNXXXHRHKPLXIDMNKXYRQTNXENXDQXXSVXERDLGXTRXXDPEDXDVPQPDEKSXXTXXSSXXDAMPRVPDVQDGVRANELQLRWQEXRELXLLXLQWXRHHTAAFEERRFPSSFEEXEILWSQFLKFKEMELPAKEADKNRSKGIYQSXEGAVQAGQLKVPPGYHPLDXEKEWGKXHVAILEREKQXRSEFERLECLQRIVTKLQMEAGLXEEQXNQXDALXQSDVRLLAAGKVPQRAGEXERDXDKXDSMIRLXFNDXQTXKDGRHPQGEQMYRRXYRLHERXVAIRTEYNLRLKAGVAAPATQVAQVTLQSVQRRPELEDSTLRYXQDXLAXXEENQHRVDGAEWGVDLPSXEAQLGSHRGLHQSXEEXRAKIERXRSDEGQLSPATRGAXRDCXGRXDLQYAKXLNSSKARLRSXESXHSXXAAXTKELMWXNEKEEEEVGFDWSDRNTNMTAKKESYSAXMRELELKEKKIKELQNAGDRLLREDHPXRPTXESFQAAXQTQWSWXLQXCCXXEAXLKENAAYFQXFSDVREXEGQXQKLQEALRRKYSCDRSATVTRLEDLLQDAQDEKEQLNEYKGHXSGXAKRXKAVVQXKPRHPAHPMRGRLPXLAVXDYKQVEVTVHKGDECQLVGPAQPSHWKVLSSSGSEAAXPSXXXLXPPPNQEXQEAXTRXEAQHQALVTLWHQLHVDMKSLLAWQSLRRDVQLIRSWSLATFRTLKPEEQRQALHSLELHYQAFLRDSQDAGGFGPEDRLMAEREYGSCSHHYQQLLQSLEQGAQEESRCQRCISELKDIRLQLEACETRTVHRLRLPLDKEPARECAQRIAEQQKAQAEVEGLGKGVARLSAEAEKVLALPEPSPAAPTLRSELELTLGKLEQVRSLSAIYLEKLKTISLVIRGTQGAEEVLRAHEEQLKEAQAVPATLPELEATKASLKKLRAQAEAQQPTFDALRDELRGAQEVGERLQQRHGERDVEVERWRERVAQLLERWQAVLAQTDVRQRELEQLGRQLRYYRESADPLGAWLQDARRRQEQIQAMPLADSQAVREQLRQEQALLEEIERHGEKVEECQRFAKQYINAIKDYELQLVTYKAQLEPVASPAKKPKVQSGSESVIQEYVDLRTHYSELTTLTSQYIKFISETLRRMEEEERLAEQQRAEERERLAEVEAALEKQRQLAEAHAQAKAQAEREAKELQQRMQEEVVRREEAAVDAQQQKRSIQEELQQLRQSSEAEIQAKARQAEAAERSRLRIEEEIRVVRLQLEATERQRGGAEGELQALRARAEEAEAQKRQAQEEAERLRRQVQDESQRKRQAEVELASRVKAEAEAAREKQRALQALEELRLQAEEAERRLRQAEVERARQVQVALETAQRSAEAELQSKRASFAEKTAQLERSLQEEHVAVAQLREEAERRAQQQAEAERAREEAERELERWQLKANEALRLRLQAEEVAQQKSLAQAEAEKQKEEAEREARRRGKAEEQAVRQRELAEQELEKQRQLAEGTAQQRLAAEQELIRLRAETEQGEQQRQLLEEELARLQREAAAATQKRQELEAELAKVRAEMEVLLASKARAEEESRSTSEKSKQRLEAEAGRFRELAEEAARLRALAEEAKRQRQLAEEDAARQRAEAERVLAEKLAAIGEATRLKTEAEIALKEKEAENERLRRLAEDEAFQRRRLEEQAAQHKADIEERLAQLRKASDSELERQKGLVEDTLRQRRQVEEEILALKASFEKAAAGKAELELELGRIRSNAEDTLRSKEQAELEAARQRQLAAEEERRRREAEERVQKSLAAEEEAARQRKAALEEVERLKAKVEEARRLRERAEQESARQLQLAQEAAQKRLQAEEKAHAFAVQQKEQELQQTLQQEQSVLDQLRGEAEAARRAAEEAEEARVQAEREAAQSRRQVEEAERLKQSAEEQAQARAQAQAAAEKLRKEAEQEAARRAQAEQAALRQKQAADAEMEKHKKFAEQTLRQKAQVEQELTTLRLQLEETDHQKNLLDEELQRLKAEATEAARQRSQVEEELFSVRVQMEELSKLKARIEAENRALILRDKDNTQRFLQEEAEKMKQVAEEAARLSVAAQEAARLRQLAEEDLAQQRALAEKMLKEKMQAVQEATRLKAEAELLQQQKELAQEQARRLQEDKEQMAQQLAEETQGFQRTLEAERQRQLEMSAEAERLKLRVAEMSRAQARAEEDAQRFRKQAEEIGEKLHRTELATQEKVTLVQTLEIQRQQSDHDAERLREAIAELEREKEKLQQEAKLLQLKSEEMQTVQQEQLLQETQALQQSFLSEKDSLLQRERFIEQEKAKLEQLFQDEVAKAQQLREEQQRQQQQMEQERQRLVASMEEARRRQHEAEEGVRRKQEELQQLEQQRRQQEELLAEENQRLREQLQLLEEQHRAALAHSEEVTASQVAATKTLPNGRDALDGPAAEAEPEHSFDGLRRKVSAQRLQEAGILSAEELQRLAQGHTTVDELARREDVRHYLQGRSSIAGLLLKATNEKLSVYAALQRQLLSPGTALILLEAQAASGFLLDPVRNRRLTVNEAVKEGVVGPELHHKLLSAERAVTGYKDPYTGQQISLFQAMQKGLIVREHGIRLLEAQIATGGVIDPVHSHRVPVDVAYRRGYFDEEMNRVLADPSDDTKGFFDPNTHENLTYLQLLERCVEDPETGLCLLPLTDKAAKGGELVYTDSEARDVFEKATVSAPFGKFQGKTVTIWEIINSEYFTAEQRRDLLRQFRTGRITVEKIIKIIITVVEEQEQKGRLCFEGLRSLVPAAELLESRVIDRELYQQLQRGERSVRDVAEVDTVRRALRGANVIAGVWLEEAGQKLSIYNALKKDLLPSDMAVALLEAQAGTGHIIDPATSARLTVDEAVRAGLVGPEFHEKLLSAEKAVTGYRDPYTGQSVSLFQALKKGLIPREQGLRLLDAQLSTGGIVDPSKSHRVPLDVACARGCLDEETSRALSAPRADAKAYSDPSTGEPATYGELQQRCRPDQLTGLSLLPLSEKAARARQEELYSELQARETFEKTPVEVPVGGFKGRTVTVWELISSEYFTAEQRQELLRQFRTGKVTVEKVIKILITIVEEVETLRQERLSFSGLRAPVPASELLASGVLSRAQFEQLKDGKTTVKDLSELGSVRTLLQGSGCLAGIYLEDTKEKVSIYEAMRRGLLRATTAALLLEAQAATGFLVDPVRNQRLYVHEAVKAGVVGPELHEQLLSAEKAVTGYRDPYSGSTISLFQAMQKGLVLRQHGIRLLEAQIATGGIIDPVHSHRVPVDVAYQRGYFSEEMNRVLADPSDDTKGFFDPNTHENLTYRQLLERCVEDPETGLRLLPLKGAEKAEVVETTQVYTEEETRRAFEETQIDIPGGGSHGGSTMSLWEVMQSDLIPEEQRAQLMADFQAGRVTKERMIIIIIEIIEKTEIIRQQGLASYDYVRRRLTAEDLFEARIISLETYNLLREGTRSLREALEAESAWCYLYGTGSVAGVYLPGSRQTLSIYQALKKGLLSAEVARLLLEAQAATGFLLDPVKGERLTVDEAVRKGLVGPELHDRLLSAERAVTGYRDPYTEQTISLFQAMKKELIPTEEALRLLDAQLATGGIVDPRLGFHLPLEVAYQRGYLNKDTHDQLSEPSEVRSYVDPSTDERLSYTQLLRRCRRDDGTGQLLLPLSDARKLTFRGLRKQITMEELVRSQVMDEATALQLREGLTSIEEVTKNLQKFLEGTSCIAGVFVDATKERLSVYQAMKKGIIRPGTAFELLEAQAATGYVIDPIKGLKLTVEEAVRMGIVGPEFKDKLLSAERAVTGYKDPYSGKLISLFQAMKKGLILKDHGIRLLEAQIATGGIIDPEESHRLPVEVAYKRGLFDEEMNEILTDPSDDTKGFFDPNTEENLTYLQLMERCITDPQTGLCLLPLKEKKRERKTSSKSSVRKRRVVIVDPETGKEMSVYEAYRKGLIDHQTYLELSEQECEWEEITISSSDGVVKSMIIDRRSGRQYDIDDAIAKNLIDRSALDQYRAGTLSITEFADMLSGNAGGFRSRSSSVGSSSSYPISPAVSRTQLASWSDPTEETGPVXGXLDTETLEKVSXTEXMHRNLVDNITGQRXXEAQXXTGGXXDPSTGERFPXTDXVNKGLVDKIMVDRXNLXQKXFCGFEDPRTKTKMSXXQXLKKGWLYYEXGQRXXEVQYLTGGLIEPDTPGRVPLDEXLQRGTVDARTAQKXRDVGXYSKYXTCPKTKLKISYKDXLDRSMVEEGTGLRXLEXAAQSTKGYYSPYSVSGSGSTAGSRTGSRTGSRAGSRRGSFDATGSGFSMTFSSSSYSSSGYGRRYASGSSASLGGPESAVA

SEQ ID NO: 711 - protein, 517 aa, Homo sapiens
  SITE (49)..(49): Xaa at position 49 is Leu, Ala, Val, Gly, or Ile
  SITE (51)..(51): Xaa at position 51 is Cys, Ala, Val, Gly, Ser, or Thr
  SITE (65)..(65): Xaa at position 65 is Val, Ala, Gly, Leu, or Ile
  SITE (67)..(67): Xaa at position 67 is Trp, Tyr, Phe, Met, His, Ile, Leu Val, Ala, or Gly
  SITE (78)..(78): Xaa at position 78 is Val, Ala, Gly, Leu, or Ile
  SITE (79)..(79): Xaa at position 79 is Ala, Gly, or Pro
  SITE (93)..(93): Xaa at position 93 is Tyr, Phe, Met, His, Ile, Leu, Val Ala, or Gly
  SITE (109)..(109): Xaa at position 109 is Ile, Ala, Val, Leu, or Gly
  SITE (111)..(111): Xaa at position 111 is Leu, Ala, Val, Gly, or Ile
  SITE (122)..(122): Xaa at position 122 is Tyr, Phe, Met, His, Ile, Leu, Val Ala, or Gly
  SITE (124)..(124): Xaa at position 124 is Cys, Ala, Val, Gly, Ser, or Thr
  SITE (126)..(126): Xaa at position 126 is Phe, Tyr, Met, His, Ile, Leu, Val Ala, or Gly
  SITE (138)..(138): Xaa at position 138 is Leu, Ala, Val, Gly, or Ile
  SITE (142)..(142): Xaa at position 142 is Val, Ala, Gly, Leu, or Ile
  SITE (168)..(168): Xaa at position 168 is Leu, Ala, Val, Gly, or Ile
  SITE (170)..(170): Xaa at position 170 is Ala, Gly, or Pro
  SITE (172)..(172): Xaa at position 172 is Cys, Ala, Val, Gly, Ser, or Thr
  SITE (213)..(213): Xaa at position 213 is Leu, Ala, Val, Gly, or Ile
  SITE (219)..(219): Xaa at position 219 is Ala, Gly, or Pro
  SITE (224)..(224): Xaa at position 224 is Leu, Ala, Val, Gly, or Ile
  SITE (226)..(226): Xaa at position 226 is Cys, Ala, Val, Gly, Ser, or Thr
  SITE (227)..(227): Xaa at position 227 is Ile, Ala, Val, Leu, or Gly
  SITE (228)..(228): Xaa at position 228 is Val, Ala, Gly, Leu, or Ile
  SITE (239)..(239): Xaa at position 239 is Leu, Ala, Val, Gly, or Ile
  SITE (243)..(243): Xaa at position 243 is Val, Ala, Gly, Leu, or Ile
  SITE (267)..(267): Xaa at position 267 is Leu, Ala, Val, Gly, or Ile
  SITE (269)..(269): Xaa at position 269 is Cys, Ala, Val, Gly, Ser, or Thr
  SITE (300)..(300): Xaa at position 300 is Leu, Ala, Val, Gly, or Ile
  SITE (302)..(302): Xaa at position 302 is Phe, Tyr, Met, His, Ile, Leu, Val Ala, or Gly
  SITE (314)..(314): Xaa at position 314 is Tyr, Phe, Met, His, Ile, Leu, Val Ala, or Gly
  SITE (316)..(316): Xaa at position 316 is Cys, Ala, Val, Gly, Ser, or Thr
  SITE (318)..(318): Xaa at position 318 is Ala, Gly, or Pro
MARMGLAGAAGRWWGLALGLTAFFLPGVHSQVVQVNDSMYGFIGTDVVXHXSFANPLPSVKITQXTXQKSTNGSKQNXXIYNPSMGVSVLAPXRERVEFLRPSFTDGTXRXSRLELEDEGVXIXEXATFPTGNRESQXNLTXMAKPTNWIEGTQAVLRAKKGQDDKVXVXTXTSANGKPPSVVSWETRLKGEAEYQEIRNPNGTVTVISRYRXVPSREXHQQSXAXXXNYHMDRFKESXTLNXQYEPEVTIEGFDGNWYLQRMDVKXTXKADANPPATEYHWTTLNGSLPKGVEAQNRTXFXKGPINYSLAGTXIXEXTNPIGTRSGQVEVNITEFPYTPSPPEHGRRAGPVPTAIIGGVAGSILLVLIVVGGIVVALRRRRHTFKGDYSTKKHVYGNGYSKAGIPQHHPPMAQNLQYPDDSDDEKKAGPLGGSSYEEEEEEEEGGGGGERKVGGPHPKYDEDAKRPYFTVDEAEARQDGYGDRTLGYQYDPEQLDLAENMVSQNDGSFISKKEWYV

SEQ ID NO: 712 - protein, 1439 aa, Homo sapiens
  SITE (77)..(77): Xaa at position 77 is Tyr, Phe, Met, His, Ile, Leu, Val Ala, or Gly
  SITE (78)..(78): Xaa at position 78 is Met, Ile, Leu, Val, Ala, or Gly
  SITE (80)..(80): Xaa at position 80 is Val, Ala, Gly, Leu, or Ile
  SITE (91)..(91): Xaa at position 91 is Ala, Gly, or Pro
  SITE (93)..(93): Xaa at position 93 is Leu, Ala, Val, Gly, or Ile
  SITE (95)..(95): Xaa at position 95 is Leu, Ala, Val, Gly, or Ile
  SITE (104)..(104): Xaa at position 104 is His, Phe, Tyr, Lys, Arg, Gly, Ser Thr, Ala, Val, Leu, Ile, Asn, Met, or Gln
  SITE (108)..(108): Xaa at position 108 is Phe, Tyr, Met, His, Ile, Leu, Val Ala, or Gly
  SITE (123)..(123): Xaa at position 123 is Leu, Ala, Val, Gly, or Ile
  SITE (125)..(125): Xaa at position 125 is Ile, Ala, Val, Leu, or Gly
  SITE (127)..(127): Xaa at position 127 is Val, Ala, Gly, Leu, or Ile
  SITE (138)..(138): Xaa at position 138 is Ile, Ala, Val, Leu, or Gly
  SITE (152)..(152): Xaa at position 152 is Ala, Gly, or Pro
  SITE (154)..(154): Xaa at position 154 is Leu, Ala, Val, Gly, or Ile
  SITE (155)..(155): Xaa at position 155 is Ala, Gly, or Pro
  SITE (156)..(156): Xaa at position 156 is Val, Ala, Gly, Leu, or Ile
  SITE (164)..(164): Xaa at position 164 is Tyr, Phe, Met, His, Ile, Leu, Val Ala, or Gly
  SITE (166)..(166): Xaa at position 166 is Val, Ala, Gly, Leu, or Ile
  SITE (168)..(168): Xaa at position 168 is Phe, Tyr, Met, His, Ile, Leu, Val Ala, or Gly
  SITE (170)..(170): Xaa at position 170 is Ala, Gly, or Pro
  SITE (180)..(180): Xaa at position 180 is Ile, Ala, Val, Leu, or Gly
  SITE (181)..(181): Xaa at position 181 is Ala, Gly, or Pro
  SITE (182)..(182): Xaa at position 182 is Ile, Ala, Val, Leu, or Gly
  SITE (214)..(214): Xaa at position 214 is Phe, Tyr, Met, His, Ile, Leu, Val Ala, or Gly
  SITE (216)..(216): Xaa at position 216 is Cys, Ala, Val, Gly, Ser, or Thr
  SITE (230)..(230): Xaa at position 230 is Leu, Ala, Val, Gly, or Ile
  SITE (253)..(253): Xaa at position 253 is Ala, Gly, or Pro
  SITE (255)..(255): Xaa at position 255 is Phe, Tyr, Met, His, Ile, Leu, Val Ala, or Gly
  SITE (268)..(268): Xaa at position 268 is Tyr, Phe, Met, His, Ile, Leu, Val Ala, or Gly
  SITE (270)..(270): Xaa at position 270 is Cys, Ala, Val, Gly, Ser, or Thr
  SITE (271)..(271): Xaa at position 271 is Val, Ala, Gly, Leu, or Ile
  SITE (280)..(280): Xaa at position 280 is Val, Ala, Gly, Leu, or Ile
  SITE (284)..(284): Xaa at position 284 is Ala, Gly, or Pro
  SITE (308)..(308): Xaa at position 308 is Leu, Ala, Val, Gly, or Ile
  SITE (310)..(310): Xaa at position 310 is Ile, Ala, Val, Leu, or Gly
  SITE (312)..(312): Xaa at position 312 is Leu, Ala, Val, Gly, or Ile
  SITE (328)..(328): Xaa at position 328 is Val, Ala, Gly, Leu, or Ile
  SITE (361)..(361): Xaa at position 361 is Ile, Ala, Val, Leu, or Gly
  SITE (365)..(365): Xaa at position 365 is Leu, Ala, Val, Gly, or Ile
  SITE (406)..(406): Xaa at position 406 is Ile, Ala, Val, Leu, or Gly
  SITE (408)..(408): Xaa at position 408 is Val, Ala, Gly, Leu, or Ile
  SITE (420)..(420): Xaa at position 420 is Cys, Ala, Val, Gly, Ser, or Thr
  SITE (427)..(427): Xaa at position 427 is Ile, Ala, Val, Leu, or Gly
  SITE (454)..(454): Xaa at position 454 is Val, Ala, Gly, Leu, or Ile
  SITE (463)..(463): Xaa at position 463 is Val, Ala, Gly, Leu, or Ile
  SITE (465)..(465): Xaa at position 465 is Leu, Ala, Val, Gly, or Ile
  SITE (467)..(467): Xaa at position 467 is Met, Ile, Leu, Val, Ala, or Gly
  SITE (469)..(469): Xaa at position 469 is Leu, Ala, Val, Gly, or Ile
  SITE (507)..(507): Xaa at position 507 is Ile, Ala, Val, Leu, or Gly
  SITE (509)..(509): Xaa at position 509 is Leu, Ala, Val, Gly, or Ile
  SITE (524)..(524): Xaa at position 524 is Tyr, Phe, Met, His, Ile, Leu, Val Ala, or Gly
  SITE (526)..(526): Xaa at position 526 is Ile, Ala, Val, Leu, or Gly
  SITE (558)..(558): Xaa at position 558 is Phe, Tyr, Met, His, Ile, Leu, Val Ala, or Gly
  SITE (567)..(567): Xaa at position 567 is Tyr, Phe, Met, His, Ile, Leu, Val Ala, or Gly
  SITE (569)..(569): Xaa at position 569 is Phe, Tyr, Met, His, Ile, Leu, Val Ala, or Gly
  SITE (571)..(571): Xaa at position 571 is Ile, Ala, Val, Leu, or Gly
  SITE (573)..(573): Xaa at position 573 is Ala, Gly, or Pro
MDTTAAAALPAFVALLLLSPWPLLGSAQGQFSAGGCTFDDGPGACDYHQDLYDDFEWVHVSAQEPHYLPPEMPQGSXXIXDSSDHDPGEKXRXQXPTMKENDTXCIDXSYLLYSQKGLNPGTXNXLXRVNKGPLANPXWNVTGFTGRDWLRXEXXXSTFWPNEXQXIXEXEVSGGRSGYXXXDDIQVLSYPCDKSPHFLRLGDVEVNAGQNATXQXIATGRDAVHNKLWXQRRNGEDIPVAQTKNINHRRFAXSXRLQEVTKTDQDLXRXXTQSERGSGXSNFXQLIVREPPRPIAPPQLLGVGPTYXLXQXNANSIIGDGPIILKEXEYRMTSGSWTETHAVNAPTYKLWHLDPDTEYEXRVLXTRPGEGGTGLPGPPLITRTKCAEPMRTPKTLKIAEIQARRXAXDWESLGYNITRXHTFNVTXCYHYFRGHNESKADCLDMDPKAPQHVXNHLPPYTNXSXKXIXTNPEGRKESEETIIQTDEDVPGPVPVKSLQGTSFENKXFXNWKEPLDPNGIITQXEXSYSSIRSFDPAVPVAGPPQTVSNLWNSTHHVXMHLHPGTTXQXFXRXSTVKGFGPATAINVTTNISAPTLPDYEGVDASLNETATTITVLLRPAQAKGAPISAYQIVVEELHPHRTKREAGAMECYQVPVTYQNAMSGGAPYYFAAELPPGNLPEPAPFTVGDNRTYQGFWNPPLAPRKGYNIYFQAMSSVEKETKTQCVRIATKAATEEPEVIPDPAKQTDRVVKIAGISAGILVFILLLLVVILIVKKSKLAKKRKDAMGNTRQEMTHMVNAMDRSYADQSTLHAEDPLSITFMDQHNFSPRYENHSATAESSRLLDVPRYLCEGTESPYQTGQLHPAIRVADLLQHINLMKTSDSYGFKEEYESFFEGQSASWDVAKKDQNRAKNRYGNIIAYDHSRVILQPVEDDPSSDYINANYIDGYQRPSHYIATQGPVHETVYDFWRMIWQEQSACIVMVTNLVEVGRVKCYKYWPDDTEVYGDFKVTCVEMEPLAEYVVRTFTLERRGYNEIREVKQFHFTGWPDHGVPYHATGLLSFIRRVKLSNPPSAGPIVVHCSAGAGRTGCYIVIDIMLDMAEREGVVDIYNCVKALRSRRINMVQTEEQYIFIHDAILEACLCGETAIPVCEFKAAYFDMIRIDSQTNSSHLKDEFQTLNSVTPRLQAEDCSIACLPRNHDKNRFMDMLPPDRCLPFLITIDGESSNYINAALMDSYRQPAAFIVTQYPLPNTVKDFWRLVYDYGCTSIVMLNEVDLSQGCPQYWPEEGMLRYGPIQVECMSCSMDCDVINRIFRICNLTRPQEGYLMVQQFQYLGWASHREVPGSKRSFLKLILQVEKWQEECEEGEGRTIIHCLNGGGRSGMFCAIGIVVEMVKRQNVVDVFHAVKTLRNSKPNMVEAPEQYRFCYDVALEYLESS

SEQ ID NO: 713 - protein, 1308 aa, Homo sapiens
  SITE (53)..(53): Xaa at position 53 is Tyr, Phe, Met, His, Ile, Leu, Val Ala, or Gly
  SITE (56)..(56): Xaa at position 56 is Cys, Ala, Val, Gly, Ser, or Thr
  SITE (58)..(58): Xaa at position 58 is Val, Ala, Gly, Leu, or Ile
  SITE (59)..(59): Xaa at position 59 is Val, Ala, Gly, Leu, or Ile
  SITE (63)..(63): Xaa at position 63 is Leu, Ala, Val, Gly, or Ile
  SITE (65)..(65): Xaa at position 65 is Ile, Ala, Val, Leu, or Gly
  SITE (68)..(68): Xaa at position 68 is Ile, Ala, Val, Leu, or Gly
  SITE (77)..(77): Xaa at position 77 is Leu, Ala, Val, Gly, or Ile
  SITE (80)..(80): Xaa at position 80 is Val, Ala, Gly, Leu, or Ile
  SITE (83)..(83): Xaa at position 83 is Val, Ala, Gly, Leu, or Ile
  SITE (87)..(87): Xaa at position 87 is Val, Ala, Gly, Leu, or Ile
  SITE (88)..(88): Xaa at position 88 is Leu, Ala, Val, Gly, or Ile
  SITE (89)..(89): Xaa at position 89 is Val, Ala, Gly, Leu, or Ile
  SITE (90)..(90): Xaa at position 90 is Ala, Gly, or Pro
  SITE (94)..(94): Xaa at position 94 is Phe, Tyr, Met, His, Ile, Leu, Val Ala, or Gly
  SITE (97)..(97): Xaa at position 97 is Leu, Ala, Val, Gly, or Ile
  SITE (99)..(99): Xaa at position 99 is Leu, Ala, Val, Gly, or Ile
  SITE (102)..(102): Xaa at position 102 is Leu, Ala, Val, Gly, or Ile
  SITE (104)..(104): Xaa at position 104 is Ile, Ala, Val, Leu, or Gly
  SITE (105)..(105): Xaa at position 105 is Ile, Ala, Val, Leu, or Gly
  SITE (116)..(116): Xaa at position 116 is Ala, Gly, or Pro
  SITE (118)..(118): Xaa at position 118 is Ala, Gly, or Pro
  SITE (119)..(119): Xaa at position 119 is Ile, Ala, Val, Leu, or Gly
  SITE (131)..(131): Xaa at position 131 is Leu, Ala, Val, Gly, or Ile
  SITE (134)..(134): Xaa at position 134 is Leu, Ala, Val, Gly, or Ile
  SITE (136)..(136): Xaa at position 136 is Leu, Ala, Val, Gly, or Ile
  SITE (139)..(139): Xaa at position 139 is Leu, Ala, Val, Gly, or Ile
  SITE (142)..(142): Xaa at position 142 is Ile, Ala, Val, Leu, or Gly
  SITE (147)..(147): Xaa at position 147 is Val, Ala, Gly, Leu, or Ile
  SITE (149)..(149): Xaa at position 149 is Val, Ala, Gly, Leu, or Ile
  SITE (158)..(158): Xaa at position 158 is Ala, Gly, or Pro
  SITE (166)..(166): Xaa at position 166 is Ile, Ala, Val, Leu, or Gly
  SITE (167)..(167): Xaa at position 167 is Val, Ala, Gly, Leu, or Ile
  SITE (197)..(197): Xaa at position 197 is Cys, Ala, Val, Gly, Ser, or Thr
  SITE (234)..(234): Xaa at position 234 is Cys, Ala, Val, Gly, Ser, or Thr
  SITE (235)..(235): Xaa at position 235 is Ala, Gly, or Pro
  SITE (248)..(248): Xaa at position 248 is Ala, Gly, or Pro
  SITE (258)..(258): Xaa at position 258 is Cys, Ala, Val, Gly, Ser, or Thr
  SITE (298)..(298): Xaa at position 298 is Val, Ala, Gly, Leu, or Ile
  SITE (334)..(334): Xaa at position 334 is Cys, Ala, Val, Gly, Ser, or Thr
  SITE (337)..(337): Xaa at position 337 is Ile, Ala, Val, Leu, or Gly
  SITE (348)..(348): Xaa at position 348 is Val, Ala, Gly, Leu, or Ile
  SITE (353)..(353): Xaa at position 353 is Ile, Ala, Val, Leu, or Gly
  SITE (356)..(356): Xaa at position 356 is Phe, Tyr, Met, His, Ile, Leu, Val Ala, or Gly
  SITE (359)..(359): Xaa at position 359 is Cys, Ala, Val, Gly, Ser, or Thr
  SITE (362)..(362): Xaa at position 362 is Ile, Ala, Val, Leu, or Gly
  SITE (366)..(366): Xaa at position 366 is Leu, Ala, Val, Gly, or Ile
  SITE (368)..(368): Xaa at position 368 is Phe, Tyr, Met, His, Ile, Leu, Val Ala, or Gly
  SITE (389)..(389): Xaa at position 389 is Leu, Ala, Val, Gly, or Ile
  SITE (392)..(392): Xaa at position 392 is Phe, Tyr, Met, His, Ile, Leu, Val Ala, or Gly
  SITE (395)..(395): Xaa at position 395 is Val, Ala, Gly, Leu, or Ile
  SITE (398)..(398): Xaa at position 398 is Ile, Ala, Val, Leu, or Gly
  SITE (402)..(402): Xaa at position 402 is Leu, Ala, Val, Gly, or Ile
  SITE (404)..(404): Xaa at position 404 is Ile, Ala, Val, Leu, or Gly
  SITE (414)..(414): Xaa at position 414 is Phe, Tyr, Met, His, Ile, Leu, Val Ala, or Gly
  SITE (416)..(416): Xaa at position 416 is Val, Ala, Gly, Leu, or Ile
  SITE (417)..(417): Xaa at position 417 is Phe, Tyr, Met, His, Ile, Leu, Val Ala, or Gly
  SITE (420)..(420): Xaa at position 420 is Leu, Ala, Val, Gly, or Ile
  SITE (423)..(423): Xaa at position 423 is Ile, Ala, Val, Leu, or Gly
  SITE (434)..(434): Xaa at position 434 is Leu, Ala, Val, Gly, or Ile
  SITE (436)..(436): Xaa at position 436 is Ile, Ala, Val, Leu, or Gly
  SITE (442)..(442): Xaa at position 442 is Ile, Ala, Val, Leu, or Gly
  SITE (445)..(445): Xaa at position 445 is Leu, Ala, Val, Gly, or Ile
  SITE (447)..(447): Xaa at position 447 is Phe, Tyr, Met, His, Ile, Leu, Val Ala, or Gly
  SITE (450)..(450): Xaa at position 450 is Leu, Ala, Val, Gly, or Ile
  SITE (453)..(453): Xaa at position 453 is Ile, Ala, Val, Leu, or Gly
  SITE (458)..(458): Xaa at position 458 is Ile, Ala, Val, Leu, or Gly
  SITE (460)..(460): Xaa at position 460 is Ile, Ala, Val, Leu, or Gly
  SITE (466)..(466): Xaa at position 466 is Leu, Ala, Val, Gly, or Ile
  SITE (467)..(467): Xaa at position 467 is Cys, Ala, Val, Gly, Ser, or Thr
  SITE (477)..(477): Xaa at position 477 is Leu, Ala, Val, Gly, or Ile
  SITE (496)..(496): Xaa at position 496 is Cys, Ala, Val, Gly, Ser, or Thr
  SITE (507)..(507): Xaa at position 507 is Cys, Ala, Val, Gly, Ser, or Thr
  SITE (512)..(512): Xaa at position 512 is Cys, Ala, Val, Gly, Ser, or Thr
  SITE (513)..(513): Xaa at position 513 is Trp, Tyr, Phe, Met, His, Ile, Leu Val, Ala, or Gly
  SITE (532)..(532): Xaa at position 532 is Cys, Ala, Val, Gly, Ser, or Thr
  SITE (748)..(748): Xaa at position 748 is Val, Ala, Gly, Leu, or Ile
  SITE (750)..(750): Xaa at position 750 is Ile, Ala, Val, Leu, or Gly
  SITE (769)..(769): Xaa at position 769 is Ala, Gly, or Pro
  SITE (773)..(773): Xaa at position 773 is Ala, Gly, or Pro
  SITE (775)..(775): Xaa at position 775 is Met, Ile, Leu, Val, Ala, or Gly
  SITE (780)..(780): Xaa at position 780 is Leu, Ala, Val, Gly, or Ile
  SITE (786)..(786): Xaa at position 786 is Val, Ala, Gly, Leu, or Ile
  SITE (787)..(787): Xaa at position 787 is Cys, Ala, Val, Gly, Ser, or Thr
  SITE (795)..(795): Xaa at position 795 is Val, Ala, Gly, Leu, or Ile
  SITE (804)..(804): Xaa at position 804 is Leu, Ala, Val, Gly, or Ile
  SITE (808)..(808): Xaa at position 808 is Val, Ala, Gly, Leu, or Ile
  SITE (820)..(820): Xaa at position 820 is Leu, Ala, Val, Gly, or Ile
  SITE (821)..(821): Xaa at position 821 is Leu, Ala, Val, Gly, or Ile
  SITE (823)..(823): Xaa at position 823 is Trp, Tyr, Phe, Met, His, Ile, Leu Val, Ala, or Gly
  SITE (824)..(824): Xaa at position 824 is Cys, Ala, Val, Gly, Ser, or Thr
  SITE (827)..(827): Xaa at position 827 is Ile, Ala, Val, Leu, or Gly
  SITE (828)..(828): Xaa at position 828 is Ala, Gly, or Pro
  SITE (831)..(831): Xaa at position 831 is Met, Ile, Leu, Val, Ala, or Gly
  SITE (834)..(834): Xaa at position 834 is Leu, Ala, Val, Gly, or Ile
  SITE (841)..(841): Xaa at position 841 is His, Phe, Tyr, Lys, Arg, Gly, Ser Thr, Ala, Val, Leu, Ile, Asn, Met, or Gln
  SITE (844)..(844): Xaa at position 844 is Leu, Ala, Val, Gly, or Ile
  SITE (845)..(845): Xaa at position 845 is Ala, Gly, or Pro
  SITE (846)..(846): Xaa at position 846 is Ala, Gly, or Pro
  SITE (849)..(849): Xaa at position 849 is Val, Ala, Gly, Leu, or Ile
  SITE (851)..(851): Xaa at position 851 is Val, Ala, Gly, Leu, or Ile
  SITE (857)..(857): Xaa at position 857 is Val, Ala, Gly, Leu, or Ile
  SITE (859)..(859): Xaa at position 859 is Ile, Ala, Val, Leu, or Gly
  SITE (864)..(864): Xaa at position 864 is Leu, Ala, Val, Gly, or Ile
  SITE (888)..(888): Xaa at position 888 is Ala, Gly, or Pro
  SITE (891)..(891): Xaa at position 891 is Cys, Ala, Val, Gly, Ser, or Thr
  SITE (903)..(903): Xaa at position 903 is Val, Ala, Gly, Leu, or Ile
  SITE (904)..(904): Xaa at position 904 is Trp, Tyr, Phe, Met, His, Ile, Leu Val, Ala, or Gly
  SITE (906)..(906): Xaa at position 906 is Tyr, Phe, Met, His, Ile, Leu, Val Ala, or Gly
  SITE (908)..(908): Xaa at position 908 is Val, Ala, Gly, Leu, or Ile
  SITE (910)..(910): Xaa at position 910 is Ile, Ala, Val, Leu, or Gly
  SITE (913)..(913): Xaa at position 913 is Leu, Ala, Val, Gly, or Ile
  SITE (914)..(914): Xaa at position 914 is Met, Ile, Leu, Val, Ala, or Gly
  SITE (929)..(929): Xaa at position 929 is Ile, Ala, Val, Leu, or Gly
  SITE (933)..(933): Xaa at position 933 is Leu, Ala, Val, Gly, or Ile
  SITE (939)..(939): Xaa at position 939 is Leu, Ala, Val, Gly, or Ile
  SITE (949)..(949): Xaa at position 949 is Val, Ala, Gly, Leu, or Ile
  SITE (953)..(953): Xaa at position 953 is Met, Ile, Leu, Val, Ala, or Gly
  SITE (956)..(956): Xaa at position 956 is Cys, Ala, Val, Gly, Ser, or Thr
  SITE (957)..(957): Xaa at position 957 is Trp, Tyr, Phe, Met, His, Ile, Leu Val, Ala, or Gly
  SITE (967)..(967): Xaa at position 967 is Phe, Tyr, Met, His, Ile, Leu, Val Ala, or Gly
  SITE (970)..(970): Xaa at position 970 is Leu, Ala, Val, Gly, or Ile
  SITE (974)..(974): Xaa at position 974 is Phe, Tyr, Met, His, Ile, Leu, Val Ala, or Gly
  SITE (977)..(977): Xaa at position 977 is Met, Ile, Leu, Val, Ala, or Gly
  SITE (985)..(985): Xaa at position 985 is Leu, Ala, Val, Gly, or Ile
MKPATGLWVWVSLLVAAGTVQPSDSQSVCAGTENKLSSLSDLEQQYRALRKYXENXEXXMGNXEXTSXEHNRDLSFXRSXREXTGYXXXXLNQXRYXPXENXRXXRGTKLYEDRYXLXXFLNYRKDGNFGXQEXGXKNXTEXLNGGXYXDQNKFLCYXDTIHWQDXXRNPWPSNLTLVSTNGSSGCGRCHKSCTGRXWGPTENHCQTLTRTVCAEQCDGRCYGPYVSDCCHREXXGGCSGPKDTDCFXCMNFNDSGAXVTQCPQTFVYNPTTFQLEHNFNAKYTYGAFCVKKCPHNFXVDSSSCVRACPSSKMEVEENGIKMCKPCTDICPKAXDGXGTGSLMSAQTXDSSNXDKXINXTKXNGNXIXLVTGIHGDPYNAIEAIDPEKXNVXRTXREXTGFXNXQSWPPNMTDXSXXSNXVTXGGRVLYSGLSXLXLKQQGXTSXQXQSXKEXSAGNXYXTDNSNXXYYHTINWTTXFSTINQRIVIRDNRKAENXTAEGMVCNHLXSSDGXXGPGPDQCLSCRRFSRGRIXIESCNLYDGEFREFENGSICVECDPQCEKMEDGLLTCHGPGPDNCTKCSHFKDGPNCVEKCPDGLQGANSFIFKYADPDRECHPCHPNCTQGCNGPTSHDCIYYPWTGHSTLPQHARTPLIAAGVIGGLFILVIVGLTFAVYVRRKSIKKKRALRRFLETELVEPLTPSGTAPNQAQLRILKETELKRVKVLGSGAFGTVYKGIWVPEGETVKIPXAXKILNETTGPKANVEFMDEXLIMXSXDHPHXVRLLGXXLSPTIQLXTQLMPHGCXLEYXHEHKDNIGSQLXXNXXVQXXKGXMYXEERRLVXRDXXXRNXLXKSPNHXKXTDFGXARLLEGDEKEYNADGGKMPIKWMXLEXIHYRKFTHQSDXXSXGXTXWEXXTFGGKPYDGIPTREXPDLXEKGERXPQPPICTIDXYMVXVKXXMIDADSRPKXKEXAAEXSRXARDPQRYXVIQGDDRMKLPSPNDSKFFQNLLDEEDLEDMMDAEEYLVPQAFNIPPPIYTSRARIDSNRSEIGHSPPPAYTPMSGNQFVYRDGGFAAEQGVSVPYRAPTSTIPEAPVAQGATAEIFDDSCCNGTLRKPVAPHVQEDSSTQRYSADPTVFAPERSPRGELDEEGYMTPMRDKPKQEYLNPVEENPFVSRRKNGDLQALDNPEYHNASNGPPKAEDEYVNEPLYLNTFANTLGKAEYLKNNILSMPEKAKKAFDNPDYWNHSLPPRSTLQHPDYLQEYSTKYFYKQNGRIRPIVAENPEYLSEFSLKPGTVLPPPPYRHRNTVV

SEQ ID NO: 714 - protein, 462 aa, Homo sapiens
  SITE (58)..(58): Xaa at position 58 is Ala, Gly, or Pro
  SITE (94)..(94): Xaa at position 94 is Ala, Gly, or Pro
  SITE (98)..(98): Xaa at position 98 is Met, Ile, Leu, Val, Ala, or Gly
  SITE (102)..(102): Xaa at position 102 is Cys, Ala, Val, Gly, Ser, or Thr
  SITE (106)..(106): Xaa at position 106 is Leu, Ala, Val, Gly, or Ile
  SITE (109)..(109): Xaa at position 109 is Leu, Ala, Val, Gly, or Ile
  SITE (110)..(110): Xaa at position 110 is Ala, Gly, or Pro
  SITE (113)..(113): Xaa at position 113 is Val, Ala, Gly, Leu, or Ile
  SITE (122)..(122): Xaa at position 122 is Leu, Ala, Val, Gly, or Ile
  SITE (124)..(124): Xaa at position 124 is Val, Ala, Gly, Leu, or Ile
  SITE (128)..(128): Xaa at position 128 is Trp, Tyr, Phe, Met, His, Ile, Leu Val, Ala, or Gly
  SITE (139)..(139): Xaa at position 139 is Leu, Ala, Val, Gly, or Ile
  SITE (140)..(140): Xaa at position 140 is His, Phe, Tyr, Lys, Arg, Gly, Ser Thr, Ala, Val, Leu, Ile, Asn, Met, or Gln
  SITE (145)..(145): Xaa at position 145 is Ala, Gly, or Pro
  SITE (146)..(146): Xaa at position 146 is Val, Ala, Gly, Leu, or Ile
  SITE (148)..(148): Xaa at position 148 is Ile, Ala, Val, Leu, or Gly
  SITE (160)..(160): Xaa at position 160 is Met, Ile, Leu, Val, Ala, or Gly
  SITE (161)..(161): Xaa at position 161 is Leu, Ala, Val, Gly, or Ile
  SITE (162)..(162): Xaa at position 162 is Ala, Gly, or Pro
  SITE (165)..(165): Xaa at position 165 is Ala, Gly, or Pro
  SITE (173)..(173): Xaa at position 173 is Val, Ala, Gly, Leu, or Ile
  SITE (181)..(181): Xaa at position 181 is Ile, Ala, Val, Leu, or Gly
  SITE (183)..(183): Xaa at position 183 is Cys, Ala, Val, Gly, Ser, or Thr
  SITE (185)..(185): Xaa at position 185 is Val, Ala, Gly, Leu, or Ile
  SITE (187)..(187): Xaa at position 187 is Ala, Gly, or Pro
  SITE (193)..(193): Xaa at position 193 is Ala, Gly, or Pro
MLLLARCLLLVLVSSLLVCSGLACGPGRGFGKRRHPKKLTPLAYKQFIPNVAEKTLGXSGRYEGKISRNSERFKELTPNYNPDIIFKDEENTGXDRLXTQRXKDKXNAXXISXMNQWPGVKXRXTEGXDEDGHHSEESXXYEGRXXDXTTSDRDRSKYGXXXRLXVEAGFDWXYYESKAHXHXSXKXENSVAXKSGGCFPGSATVHLEQGGTKLVKDLSPGDRVLAADDQGRLLYSDFLTFLDRDDGAKKVFYVIETREPRERLLLTAAHLLFVAPHNDSATGEPEASSGSGPPSGGALGPRALFASRVRPGQRVYVVAERDGDRRLLPAAVHSVTLSEEAAGAYAPLTAQGTILINRVLASCYAVIEEHSWAHRAFAPFRLAHALLAALAPARTDRGGDSGGGDRGGGGGRVALTAPGAADAPGAGATAGIHWYSQLLYQIGTWLLDSEALHPLGMAVKSS

SEQ ID NO: 715 - protein, 683 aa, Homo sapiens
  SITE (505)..(505): Xaa at position 505 is Val, Ala, Gly, Leu, or Ile
  SITE (506)..(506): Xaa at position 506 is Met, Ile, Leu, Val, Ala, or Gly
  SITE (509)..(509): Xaa at position 509 is Leu, Ala, Val, Gly, or Ile
  SITE (515)..(515): Xaa at position 515 is Phe, Tyr, Met, His, Ile, Leu, Val Ala, or Gly
  SITE (518)..(518): Xaa at position 518 is Leu, Ala, Val, Gly, or Ile
  SITE (521)..(521): Xaa at position 521 is Ala, Gly, or Pro
  SITE (522)..(522): Xaa at position 522 is Ile, Ala, Val, Leu, or Gly
  SITE (531)..(531): Xaa at position 531 is Leu, Ala, Val, Gly, or Ile
  SITE (539)..(539): Xaa at position 539 is Val, Ala, Gly, Leu, or Ile
  SITE (540)..(540): Xaa at position 540 is Phe, Tyr, Met, His, Ile, Leu, Val Ala, or Gly
  SITE (541)..(541): Xaa at position 541 is Ala, Gly, or Pro
  SITE (546)..(546): Xaa at position 546 is Ala, Gly, or Pro
  SITE (565)..(565): Xaa at position 565 is Leu, Ala, Val, Gly, or Ile
  SITE (572)..(572): Xaa at position 572 is His, Phe, Tyr, Lys, Arg, Gly, Ser Thr, Ala, Val, Leu, Ile, Asn, Met, or Gln
  SITE (573)..(573): Xaa at position 573 is Ile, Ala, Val, Leu, or Gly
  SITE (589)..(589): Xaa at position 589 is Leu, Ala, Val, Gly, or Ile
  SITE (597)..(597): Xaa at position 597 is Leu, Ala, Val, Gly, or Ile
  SITE (599)..(599): Xaa at position 599 is Val, Ala, Gly, Leu, or Ile
  SITE (606)..(606): Xaa at position 606 is Val, Ala, Gly, Leu, or Ile
  SITE (608)..(608): Xaa at position 608 is Val, Ala, Gly, Leu, or Ile
  SITE (624)..(624): Xaa at position 624 is Val, Ala, Gly, Leu, or Ile
  SITE (625)..(625): Xaa at position 625 is Val, Ala, Gly, Leu, or Ile
  SITE (626)..(626): Xaa at position 626 is His, Phe, Tyr, Lys, Arg, Gly, Ser Thr, Ala, Val, Leu, Ile, Asn, Met, or Gln
  SITE (627)..(627): Xaa at position 627 is Val, Ala, Gly, Leu, or Ile
  SITE (628)..(628): Xaa at position 628 is Ile, Ala, Val, Leu, or Gly
  SITE (632)..(632): Xaa at position 632 is Leu, Ala, Val, Gly, or Ile
MALFVRLLALALALALGPAATLAGPAKSPYQLVLQHSRLRGRQHGPNVCAVQKVIGTNRKYFTNCKQWYQRKICGKSTVISYECCPGYEKVPGEKGCPAALPLSNLYETLGVVGSTTTQLYTDRTEKLRPEMEGPGSFTIFAPSNEAWASLPAEVLDSLVSNVNIELLNALRYHMVGRRVLTDELKHGMTLTSMYQNSNIQIHHYPNGIVTVNCARLLKADHHATNGVVHLIDKVISTITNNIQQIIEIEDTFETLRAAVAASGLNTMLEGNGQYTLLAPTNEAFEKIPSETLNRILGDPEALRDLLNNHILKSAMCAEAIVAGLSVETLEGTTLEVGCSGDMLTINGKAIISNKDILATNGVIHYIDELLIPDSAKTLFELAAESDVSTAIDLFRQAGLGNHLSGSERLTLLAPLNSVFKDGTPPIDAHTRNLLRNHIIKDQLASKYLYHGQTLETLGGKKLRVFVYRNSLCIENSCIAAHDKRGRYGTLFTMDRVLTPPMGTXXDVXKGDNRXSMXVAXXQSAGLTETXNREGVYTXXXPTNEXFRALPPRERSRLLGDAKEXANILKYXXGDEILVSGGIGALVRXKSLQGDKXEXSLKNNVXSXNKEPVAEPDIMATNGXXXXXTNVXQPPANRPQERGDELADSALEIFKQASAFSRASQRSVRLAPVYQKLLERMKH

SEQ ID NO: 716 - protein, 1914 aa, Homo sapiens
  SITE (1536)..(1536): Xaa at position 1536 is Met, Ile, Leu, Val, Ala, or Gly
  SITE (1688)..(1688): Xaa at position 1688 is Ile, Ala, Val, Leu, or Gly
  SITE (1714)..(1714): Xaa at position 1714 is Leu, Ala, Val, Gly, or Ile
MGDVKLVASSHISKTSLSVDPSRVDSMPLTEAPAFILPPRNLCIKEGATAKFEGRVRGYPEPQVTWHRNGQPITSGGRFLLDCGIRGTFSLVIHAVHEEDRGKYTCEATNGSGARQVTVELTVEGSFAKQLGQPVVSKTLGDRFSAPAVETRPSIWGECPPKFATKLGRVVVKEGQMGRFSCKITGRPQPQVTWLKGNVPLQPSARVSVSEKNGMQVLEIHGVNQDDVGVYTCLVVNGSGKASMSAELSIQGLDSANRSFVRETKATNSDVRKEVTNVISKESKLDSLEAAAKSKNCSSPQRGGSPPWAANSQPQPPRESKLESCKDSPRTAPQTPVLQKTSSSITLQAARVQPEPRAPGLGVLSPSGEERKRPAPPRPATFPTRQPGLGSQDVVSKAANRRIPMEGQRDSAFPKFESKPQSQEVKENQTVKFRCEVSGIPKPEVAWFLEGTPVRRQEGSIEVYEDAGSHYLCLLKARTRDSGTYSCTASNAQGQLSCSWTLQVERLAVMEVAPSFSSVLKDCAVIEGQDFVLQCSVRGTPVPRITWLLNGQPIQYARSTCEAGVAELHIQDALPEDHGTYTCLAENALGQVSCSAWVTVHEKKSSRKSEYLLPVAPSKPTAPIFLQGLSDLKVMDGSQVTMTVQVSGNPPPEVIWLHNGNEIQESEDFHFEQRGTQHSLCIQEVFPEDTGTYTCEAWNSAGEVRTQAVLTVQEPHDGTQPWFISKPRSVTASLGQSVLISCAIAGDPFPTVHWLRDGKALCKDTGHFEVLQNEDVFTLVLKKVQPWHAGQYEILLKNRVGECSCQVSLMLQNSSARALPRGREPASCEDLCGGGVGADGGGSDRYGSLRPGWPARGQGWLEEEDGEDVRGVLKRRVETRQHTEEAIRQQEVEQLDFRDLLGKKVSTKTLSEDDLKEIPAEQMDFRANLQRQVKPKTVSEEERKVHSPQQVDFRSVLAKKGTSKTPVPEKVPPPKPATPDFRSVLGGKKKLPAENGSSSAETLNAKAVESSKPLSNAQPSGPLKPVGNAKPAETLKPMGNAKPAETLKPMGNAKPDENLKSASKEELKKDVKNDVNCKRGHAGTTDNEKRSESQGTAPAFKQKLQDVHVAEGKKLLLQCQVSSDPPATIIWTLNGKTLKTTKFIILSQEGSLCSVSIEKALPEDRGLYKCVAKNDAGQAECSCQVTVDDAPASENTKAPEMKSRRPKSSLPPVLGTESDATVKKKPAPKTPPKAAMPPQIIQFPEDQKVRAGESVELFGKVTGTQPITCTWMKFRKQIQESEHMKVENSENGSKLTILAARQEHCGCYTLLVENKLGSRQAQVNLTVVDKPDPPAGTPCASDIRSSSLTLSWYGSSYDGGSAVQSYSIEIWDSANKTWKELATCRSTSFNVQDLLPDHEYKFRVRAINVYGTSEPSQESELTTVGEKPEEPKDEVEVSDDDEKEPEVDYRTVTINTEQKVSDFYDIEERLGSGKFGQVFRLVEKKTRKVWAGKFFKAYSAKEKENIRQEISIMNCLHHPKLVQCVDAFEEKANIVXVLEIVSGGELFERIIDEDFELTERECIKYMRQISEGVEYIHKQGIVHLDLKPENIMCVNKTGTRIKLIDFGLARRLENAGSLKVLFGTPEFVAPEVINYEPIGYATDMWSIGVICYILVSGLSPFMGDNDNETLANVTSATWDFDDEAFDEXSDDAKDFISNLLKKDMKNRLDCTQCXQHPWLMKDTKNMEAKKLSKDRMKKYMARRKWQKTGNAVRAIGRLSSMAMISGLSGRKSSTGSPTSPLNAEKLESEEDVSQAFLEAVAEEKPHVKPYFSKTIRDLEVVEGSAARFDCKIEGYPDPEVVWFKDDQSIRESRHFQIDYDEDGNCSLIISDVCGDDDAKYTCKAVNSLGEATCTAELIVETMEEGEGEGEEEEE

SEQ ID NO: 717 - protein, 529 aa, Homo sapiens
  SITE (163)..(163): Xaa at position 163 is Ala, Gly, or Pro
  SITE (164)..(164): Xaa at position 164 is His, Phe, Tyr, Lys, Arg, Gly, Ser Thr, Ala, Val, Leu, Ile, Asn, Met, or Gln
  SITE (177)..(177): Xaa at position 177 is Ala, Gly, or Pro
  SITE (211)..(211): Xaa at position 211 is Ile, Ala, Val, Leu, or Gly
  SITE (213)..(213): Xaa at position 213 is Leu, Ala, Val, Gly, or Ile
  SITE (286)..(286): Xaa at position 286 is Val, Ala, Gly, Leu, or Ile
  SITE (314)..(314): Xaa at position 314 is Ile, Ala, Val, Leu, or Gly
  SITE (349)..(349): Xaa at position 349 is Val, Ala, Gly, Leu, or Ile
MGPSCPVFLSFTKLSLWWLLLTPAGGEEAKRPPPRAPGDPLSSPSPTALPQGGSHTETEDRLFKHLFRGYNRWARPVPNTSDVVIVRFGLSIAQLIDVDEKNQMMTTNVWLKQEWSDYKLRWNPTDFGNITSLRVPSEMIWIPDIVLYNNADGEFAVTHMTKXXLFSTGTVHWVPPXIYKSSCSIDVTFFPFDQQNCKMKFGSWTYDKAKXDXEQMEQTVDLKDYWESGEWAIVNATGTYNSKKYDCCAEIYPDVTYAFVIRRLPLFYTINLIIPCLLISCLTVLXFYLPSDCGEKITLCISVLLSLTVFLLLXTEIIPSTSLVIPLIGEYLLFTMIFVTLSIVITVFXLNVHHRSPSTHTMPHWVRGALLGCVPRWLLMNRPPPPVELCHPLRLKLSPSYHWLESNVDAEEREVVVEEEDRWACAGHVAPSVGTLCSHGHLHSGASGPKAEALLQEGELLLSPHMQKALEGVHYIADHLRSEDADSSVKEDWKYVAMVIDRIFLWLFIIVCFLGTIGLFLPPFLAGMI

SEQ ID NO: 718 - protein, 433 aa, Homo sapiens
  SITE (77)..(77): Xaa at position 77 is Val, Ala, Gly, Leu, or Ile
  SITE (80)..(80): Xaa at position 80 is Leu, Ala, Val, Gly, or Ile
  SITE (127)..(127): Xaa at position 127 is Met, Ile, Leu, Val, Ala, or Gly
  SITE (128)..(128): Xaa at position 128 is Val, Ala, Gly, Leu, or Ile
  SITE (139)..(139): Xaa at position 139 is Met, Ile, Leu, Val, Ala, or Gly
  SITE (140)..(140): Xaa at position 140 is Leu, Ala, Val, Gly, or Ile
  SITE (153)..(153): Xaa at position 153 is Ala, Gly, or Pro
  SITE (157)..(157): Xaa at position 157 is Phe, Tyr, Met, His, Ile, Leu, Val Ala, or Gly
  SITE (161)..(161): Xaa at position 161 is Ile, Ala, Val, Leu, or Gly
  SITE (164)..(164): Xaa at position 164 is Leu, Ala, Val, Gly, or Ile
  SITE (167)..(167): Xaa at position 167 is Leu, Ala, Val, Gly, or Ile
  SITE (172)..(172): Xaa at position 172 is Ile, Ala, Val, Leu, or Gly
  SITE (173)..(173): Xaa at position 173 is Val, Ala, Gly, Leu, or Ile
  SITE (174)..(174): Xaa at position 174 is His, Phe, Tyr, Lys, Arg, Gly, Ser Thr, Ala, Val, Leu, Ile, Asn, Met, or Gln
  SITE (177)..(177): Xaa at position 177 is Ile, Ala, Val, Leu, or Gly
  SITE (182)..(182): Xaa at position 182 is Leu, Ala, Val, Gly, or Ile
  SITE (190)..(190): Xaa at position 190 is Leu, Ala, Val, Gly, or Ile
  SITE (192)..(192): Xaa at position 192 is Ile, Ala, Val, Leu, or Gly
  SITE (210)..(210): Xaa at position 210 is Cys, Ala, Val, Gly, Ser, or Thr
  SITE (236)..(236): Xaa at position 236 is Val, Ala, Gly, Leu, or Ile
  SITE (239)..(239): Xaa at position 239 is Trp, Tyr, Phe, Met, His, Ile, Leu Val, Ala, or Gly
  SITE (241)..(241): Xaa at position 241 is Ala, Gly, or Pro
  SITE (243)..(243): Xaa at position 243 is Val, Ala, Gly, Leu, or Ile
  SITE (245)..(245): Xaa at position 245 is Leu, Ala, Val, Gly, or Ile
  SITE (255)..(255): Xaa at position 255 is Phe, Tyr, Met, His, Ile, Leu, Val Ala, or Gly
  SITE (267)..(267): Xaa at position 267 is Ile, Ala, Val, Leu, or Gly
  SITE (285)..(285): Xaa at position 285 is Leu, Ala, Val, Gly, or Ile
  SITE (286)..(286): Xaa at position 286 is Leu, Ala, Val, Gly, or Ile
  SITE (289)..(289): Xaa at position 289 is Met, Ile, Leu, Val, Ala, or Gly
  SITE (303)..(303): Xaa at position 303 is Ile, Ala, Val, Leu, or Gly
MEVVDPQQLGMFTEGELMSVGMDTFIHRIDSTEVIYQPRRKRAKLIGKYLMGDLLGEGSYGKVKEVLDSETLCRRAXKIXKKKKLRRIPNGEANVKKEIQLLRRLRHKNVIQLVDVLYNEEKQKMYXXMEYCVCGMQEXXDSVPEKRFPVCQXHGYXCQLXDGXEYXHSQGXXXKDXKPGNXLLTTGGTXKXSDLGVAEALHPFAADDTXRTSQGSPAFQPPEIANGLDTFSGFKXDIXSXGXTXYNITTGLYPXEGDNIYKLFENXGKGSYAIPGDCGPPLSDXXKGXLEYEPAKRFSIRQXRQHSWFRKKHPPAEAPVPIPPSPDTKDRWRSMTVVPYLEDLHGADEDEDLFDIEDDIIYTQDFTVPGQVPEEEASHNGQRRGLPKAVCMNGTEAAQLSTKSRAEGRAPNPARKACSASSKIRRLSACKQQ

SEQ ID NO: 719 - protein, 593 aa, Homo sapiens
  SITE (6)..(6): Xaa at position 6 is Leu, Ala, Val, Gly, or Ile
  SITE (10)..(10): Xaa at position 10 is Val, Ala, Gly, Leu, or Ile
  SITE (14)..(14): Xaa at position 14 is Ile, Ala, Val, Leu, or Gly
  SITE (18)..(18): Xaa at position 18 is Val, Ala, Gly, Leu, or Ile
  SITE (19)..(19): Xaa at position 19 is Ile, Ala, Val, Leu, or Gly
  SITE (22)..(22): Xaa at position 22 is Val, Ala, Gly, Leu, or Ile
  SITE (30)..(30): Xaa at position 30 is Val, Ala, Gly, Leu, or Ile
  SITE (31)..(31): Xaa at position 31 is Leu, Ala, Val, Gly, or Ile
  SITE (32)..(32): Xaa at position 32 is Ile, Ala, Val, Leu, or Gly
  SITE (33)..(33): Xaa at position 33 is Met, Ile, Leu, Val, Ala, or Gly
  SITE (40)..(40): Xaa at position 40 is Ile, Ala, Val, Leu, or Gly
  SITE (41)..(41): Xaa at position 41 is Leu, Ala, Val, Gly, or Ile
  SITE (50)..(50): Xaa at position 50 is Ile, Ala, Val, Leu, or Gly
  SITE (57)..(57): Xaa at position 57 is Ile, Ala, Val, Leu, or Gly
  SITE (61)..(61): Xaa at position 61 is Ile, Ala, Val, Leu, or Gly
  SITE (73)..(73): Xaa at position 73 is Ala, Gly, or Pro
  SITE (74)..(74): Xaa at position 74 is Ile, Ala, Val, Leu, or Gly
  SITE (75)..(75): Xaa at position 75 is Tyr, Phe, Met, His, Ile, Leu, Val Ala, or Gly
  SITE (77)..(77): Xaa at position 77 is Leu, Ala, Val, Gly, or Ile
  SITE (84)..(84): Xaa at position 84 is Val, Ala, Gly, Leu, or Ile
  SITE (87)..(87): Xaa at position 87 is Leu, Ala, Val, Gly, or Ile
  SITE (91)..(91): Xaa at position 91 is Phe, Tyr, Met, His, Ile, Leu, Val Ala, or Gly
  SITE (99)..(99): Xaa at position 99 is Tyr, Phe, Met, His, Ile, Leu, Val Ala, or Gly
  SITE (102)..(102): Xaa at position 102 is Ala, Gly, or Pro
  SITE (104)..(104): Xaa at position 104 is Ile, Ala, Val, Leu, or Gly
  SITE (105)..(105): Xaa at position 105 is Phe, Tyr, Met, His, Ile, Leu, Val Ala, or Gly
  SITE (106)..(106): Xaa at position 106 is Phe, Tyr, Met, His, Ile, Leu, Val Ala, or Gly
  SITE (114)..(114): Xaa at position 114 is Leu, Ala, Val, Gly, or Ile
  SITE (118)..(118): Xaa at position 118 is Leu, Ala, Val, Gly, or Ile
  SITE (123)..(123): Xaa at position 123 is Leu, Ala, Val, Gly, or Ile
  SITE (135)..(135): Xaa at position 135 is Leu, Ala, Val, Gly, or Ile
  SITE (136)..(136): Xaa at position 136 is Ala, Gly, or Pro
  SITE (137)..(137): Xaa at position 137 is Phe, Tyr, Met, His, Ile, Leu, Val Ala, or Gly
  SITE (144)..(144): Xaa at position 144 is Val, Ala, Gly, Leu, or Ile
  SITE (145)..(145): Xaa at position 145 is Phe, Tyr, Met, His, Ile, Leu, Val Ala, or Gly
  SITE (147)..(147): Xaa at position 147 is Leu, Ala, Val, Gly, or Ile
  SITE (149)..(149): Xaa at position 149 is Ala, Gly, or Pro
  SITE (169)..(169): Xaa at position 169 is Leu, Ala, Val, Gly, or Ile
  SITE (172)..(172): Xaa at position 172 is Leu, Ala, Val, Gly, or Ile
  SITE (173)..(173): Xaa at position 173 is Ala, Gly, or Pro
  SITE (176)..(176): Xaa at position 176 is Ile, Ala, Val, Leu, or Gly
  SITE (177)..(177): Xaa at position 177 is Ala, Gly, or Pro
  SITE (179)..(179): Xaa at position 179 is Leu, Ala, Val, Gly, or Ile
  SITE (180)..(180): Xaa at position 180 is Cys, Ala, Val, Gly, Ser, or Thr
  SITE (188)..(188): Xaa at position 188 is Ala, Gly, or Pro
  SITE (189)..(189): Xaa at position 189 is Ile, Ala, Val, Leu, or Gly
  SITE (201)..(201): Xaa at position 201 is Leu, Ala, Val, Gly, or Ile
  SITE (202)..(202): Xaa at position 202 is Ala, Gly, or Pro
  SITE (205)..(205): Xaa at position 205 is Val, Ala, Gly, Leu, or Ile
  SITE (209)..(209): Xaa at position 209 is Leu, Ala, Val, Gly, or Ile
  SITE (230)..(230): Xaa at position 230 is Leu, Ala, Val, Gly, or Ile
  SITE (231)..(231): Xaa at position 231 is Leu, Ala, Val, Gly, or Ile
  SITE (232)..(232): Xaa at position 232 is Ile, Ala, Val, Leu, or Gly
  SITE (233)..(233): Xaa at position 233 is Met, Ile, Leu, Val, Ala, or Gly
  SITE (236)..(236): Xaa at position 236 is Ala, Gly, or Pro
  SITE (237)..(237): Xaa at position 237 is Ala, Gly, or Pro
  SITE (240)..(240): Xaa at position 240 is Val, Ala, Gly, Leu, or Ile
  SITE (243)..(243): Xaa at position 243 is Leu, Ala, Val, Gly, or Ile
  SITE (247)..(247): Xaa at position 247 is Leu, Ala, Val, Gly, or Ile
  SITE (249)..(249): Xaa at position 249 is Phe, Tyr, Met, His, Ile, Leu, Val Ala, or Gly
  SITE (252)..(252): Xaa at position 252 is Met, Ile, Leu, Val, Ala, or Gly
  SITE (253)..(253): Xaa at position 253 is Ala, Gly, or Pro
  SITE (291)..(291): Xaa at position 291 is Leu, Ala, Val, Gly, or Ile
  SITE (299)..(299): Xaa at position 299 is Val, Ala, Gly, Leu, or Ile
  SITE (303)..(303): Xaa at position 303 is Val, Ala, Gly, Leu, or Ile
  SITE (326)..(326): Xaa at position 326 is Leu, Ala, Val, Gly, or Ile
  SITE (346)..(346): Xaa at position 346 is His, Phe, Tyr, Lys, Arg, Gly, Ser Thr, Ala, Val, Leu, Ile, Asn, Met, or Gln
  SITE (348)..(348): Xaa at position 348 is His, Phe, Tyr, Lys, Arg, Gly, Ser Thr, Ala, Val, Leu, Ile, Asn, Met, or Gln
  SITE (349)..(349): Xaa at position 349 is Leu, Ala, Val, Gly, or Ile
  SITE (350)..(350): Xaa at position 350 is Ala, Gly, or Pro
  SITE (353)..(353): Xaa at position 353 is Cys, Ala, Val, Gly, Ser, or Thr
  SITE (361)..(361): Xaa at position 361 is Val, Ala, Gly, Leu, or Ile
  SITE (364)..(364): Xaa at position 364 is Leu, Ala, Val, Gly, or Ile
  SITE (365)..(365): Xaa at position 365 is Cys, Ala, Val, Gly, Ser, or Thr
  SITE (371)..(371): Xaa at position 371 is Leu, Ala, Val, Gly, or Ile
  SITE (388)..(388): Xaa at position 388 is Leu, Ala, Val, Gly, or Ile
  SITE (389)..(389): Xaa at position 389 is Ile, Ala, Val, Leu, or Gly
  SITE (392)..(392): Xaa at position 392 is Val, Ala, Gly, Leu, or Ile
  SITE (393)..(393): Xaa at position 393 is Leu, Ala, Val, Gly, or Ile
  SITE (394)..(394): Xaa at position 394 is Leu, Ala, Val, Gly, or Ile
  SITE (404)..(404): Xaa at position 404 is Ile, Ala, Val, Leu, or Gly
  SITE (406)..(406): Xaa at position 406 is Val, Ala, Gly, Leu, or Ile
  SITE (407)..(407): Xaa at position 407 is Leu, Ala, Val, Gly, or Ile
  SITE (408)..(408): Xaa at position 408 is Leu, Ala, Val, Gly, or Ile
  SITE (409)..(409): Xaa at position 409 is Leu, Ala, Val, Gly, or Ile
  SITE (410)..(410): Xaa at position 410 is Tyr, Phe, Met, His, Ile, Leu, Val Ala, or Gly
  SITE (411)..(411): Xaa at position 411 is Ile, Ala, Val, Leu, or Gly
  SITE (412)..(412): Xaa at position 412 is Leu, Ala, Val, Gly, or Ile
  SITE (422)..(422): Xaa at position 422 is Leu, Ala, Val, Gly, or Ile
  SITE (425)..(425): Xaa at position 425 is Leu, Ala, Val, Gly, or Ile
  SITE (426)..(426): Xaa at position 426 is Ile, Ala, Val, Leu, or Gly
  SITE (429)..(429): Xaa at position 429 is Ala, Gly, or Pro
  SITE (437)..(437): Xaa at position 437 is Leu, Ala, Val, Gly, or Ile
  SITE (438)..(438): Xaa at position 438 is Ile, Ala, Val, Leu, or Gly
  SITE (441)..(441): Xaa at position 441 is Leu, Ala, Val, Gly, or Ile
  SITE (444)..(444): Xaa at position 444 is Leu, Ala, Val, Gly, or Ile
  SITE (448)..(448): Xaa at position 448 is Val, Ala, Gly, Leu, or Ile
  SITE (466)..(466): Xaa at position 466 is Met, Ile, Leu, Val, Ala, or Gly
  SITE (479)..(479): Xaa at position 479 is Ile, Ala, Val, Leu, or Gly
  SITE (482)..(482): Xaa at position 482 is Val, Ala, Gly, Leu, or Ile
  SITE (483)..(483): Xaa at position 483 is Met, Ile, Leu, Val, Ala, or Gly
  SITE (486)..(486): Xaa at position 486 is Ala, Gly, or Pro
  SITE (534)..(534): Xaa at position 534 is Leu, Ala, Val, Gly, or Ile
  SITE (535)..(535): Xaa at position 535 is Ile, Ala, Val, Leu, or Gly
  SITE (536)..(536): Xaa at position 536 is Val, Ala, Gly, Leu, or Ile
  SITE (537)..(537): Xaa at position 537 is Tyr, Phe, Met, His, Ile, Leu, Val Ala, or Gly
  SITE (538)..(538): Xaa at position 538 is Val, Ala, Gly, Leu, or Ile
  SITE (539)..(539): Xaa at position 539 is Met, Ile, Leu, Val, Ala, or Gly
  SITE (542)..(542): Xaa at position 542 is Val, Ala, Gly, Leu, or Ile
  SITE (544)..(544): Xaa at position 544 is Met, Ile, Leu, Val, Ala, or Gly
  SITE (547)..(547): Xaa at position 547 is Met, Ile, Leu, Val, Ala, or Gly
  SITE (549)..(549): Xaa at position 549 is Ala, Gly, or Pro
  SITE (550)..(550): Xaa at position 550 is Ala, Gly, or Pro
  SITE (553)..(553): Xaa at position 553 is Val, Ala, Gly, Leu, or Ile
  SITE (563)..(563): Xaa at position 563 is Val, Ala, Gly, Leu, or Ile
  SITE (564)..(564): Xaa at position 564 is Leu, Ala, Val, Gly, or Ile
  SITE (565)..(565): Xaa at position 565 is Ile, Ala, Val, Leu, or Gly
  SITE (569)..(569): Xaa at position 569 is His, Phe, Tyr, Lys, Arg, Gly, Ser Thr, Ala, Val, Leu, Ile, Asn, Met, or Gln
  SITE (571)..(571): Xaa at position 571 is Leu, Ala, Val, Gly, or Ile
  SITE (576)..(576): Xaa at position 576 is Phe, Tyr, Met, His, Ile, Leu, Val Ala, or Gly
  SITE (577)..(577): Xaa at position 577 is Leu, Ala, Val, Gly, or Ile
  SITE (580)..(580): Xaa at position 580 is Leu, Ala, Val, Gly, or Ile
  SITE (583)..(583): Xaa at position 583 is Leu, Ala, Val, Gly, or Ile
MAPSGXKAVXGEKXLSGXXRSXKKDGEWKXXXXDHPSMRXXSSCCKMSDXLAEGITXVEDXNKRREPIPSLEXXXLXSPTEKSXQAXIKDXQGTPTFTXKAXHXXXTDTCPEPXFSEXGRSRXAKVVKTLKEIHXXXLPYEAQXXSXDXPHSTYNLYCPFRAEERTRQXEVXXQQXXTXXATLQEYPXXRYRKGPEDTAQXXHAXLAKXNAFKADTPSLGEGPEKTRSQXXXXDRXXDPXSPXLHEXTXQAXXYDLLDIEQDTYRYETTGLSEAREKAVLLDEDDDLWVEXRHMHIADXSKKXTELLRTFCESKRLTTDKANIKDXSQILKKMPQYQKELNKYSTXLXXXDDXMKHFKGSXEKXXSVEQDXAMGSDAEGEKIKDSMKXXVPXXXDAAVPAYDKXRXXXXXXXLRNGVSEENXAKXXQHXNVQAHSSXXRNXEQXGGTXTNPGGSGTSSRLEPRERXEPTYQLSRWTPVXKDXXEDXVEDRLDRNLWPFVSDPAPTASSQAAVSARFGHWHKNKAGIEARAGPRXXXXXXGGXAXSEXRXXYEXTRATEGKWEXXXGSSXIXTPTRXXDDXKAXDKKLEDIALP

SEQ ID NO: 720 - protein, 244 aa, Homo sapiens
  SITE (6)..(6): Xaa at position 6 is Ala, Gly, or Pro
  SITE (13)..(13): Xaa at position 13 is Leu, Ala, Val, Gly, or Ile
  SITE (25)..(25): Xaa at position 25 is Pro, Met, Leu, Ile, Val, Ala or Gly
  SITE (27)..(27): Xaa at position 27 is Val, Ala, Gly, Leu, or Ile
  SITE (29)..(29): Xaa at position 29 is Leu, Ala, Val, Gly, or Ile
  SITE (34)..(34): Xaa at position 34 is Gly, Ala, or Pro
  SITE (38)..(38): Xaa at position 38 is Gly, Ala, or Pro
  SITE (74)..(74): Xaa at position 74 is Ile, Ala, Val, Leu, or Gly
  SITE (76)..(76): Xaa at position 76 is Pro, Met, Leu, Ile, Val, Ala or Gly
  SITE (97)..(97): Xaa at position 97 is Ile, Ala, Val, Leu, or Gly
  SITE (114)..(114): Xaa at position 114 is Ala, Gly, or Pro
  SITE (115)..(115): Xaa at position 115 is Phe, Tyr, Met, His, Ile, Leu, Val Ala, or Gly
  SITE (117)..(117): Xaa at position 117 is Val, Ala, Gly, Leu, or Ile
  SITE (132)..(132): Xaa at position 132 is Phe, Tyr, Met, His, Ile, Leu, Val Ala, or Gly
  SITE (150)..(150): Xaa at position 150 is Phe, Tyr, Met, His, Ile, Leu, Val Ala, or Gly
  SITE (157)..(157): Xaa at position 157 is Leu, Ala, Val, Gly, or Ile
  SITE (158)..(158): Xaa at position 158 is Tyr, Phe, Met, His, Ile, Leu, Val Ala, or Gly
  SITE (160)..(160): Xaa at position 160 is Phe, Tyr, Met, His, Ile, Leu, Val Ala, or Gly
  SITE (161)..(161): Xaa at position 161 is Ala, Gly, or Pro
  SITE (162)..(162): Xaa at position 162 is Tyr, Phe, Met, His, Ile, Leu, Val Ala, or Gly
  SITE (166)..(166): Xaa at position 166 is Val, Ala, Gly, Leu, or Ile
  SITE (171)..(171): Xaa at position 171 is Val, Ala, Gly, Leu, or Ile
  SITE (173)..(173): Xaa at position 173 is Val, Ala, Gly, Leu, or Ile
  SITE (175)..(175): Xaa at position 175 is Leu, Ala, Val, Gly, or Ile
  SITE (183)..(183): Xaa at position 183 is Leu, Ala, Val, Gly, or Ile
  SITE (201)..(201): Xaa at position 201 is Val, Ala, Gly, Leu, or Ile
  SITE (202)..(202): Xaa at position 202 is Leu, Ala, Val, Gly, or Ile
  SITE (203)..(203): Xaa at position 203 is Leu, Ala, Val, Gly, or Ile
  SITE (205)..(205): Xaa at position 205 is Leu, Ala, Val, Gly, or Ile
  SITE (211)..(211): Xaa at position 211 is Val, Ala, Gly, Leu, or Ile
  SITE (213)..(213): Xaa at position 213 is Leu, Ala, Val, Gly, or Ile
  SITE (234)..(234): Xaa at position 234 is Phe, Tyr, Met, His, Ile, Leu, Val Ala, or Gly
  SITE (237)..(237): Xaa at position 237 is Phe, Tyr, Met, His, Ile, Leu, Val Ala, or Gly
  SITE (238)..(238): Xaa at position 238 is Leu, Ala, Val, Gly, or Ile
MLLLGXVLLLLAXPGHDQETTTQGXGXLXPLPKXACTXWMAGIPGHPGHNGAPGRDGRDGTPGEKGEKGDPGLXGXKGDIGETGVPGAEGPRGFPGXQGRKGEPGEGAYVYRSXXSXGLETYVTIPNMPIRXTKIFYNQQNHYDGSTGKXHCNIPGXXYXXXHITXYMKDXKXSXFKKDKAMXFTYDQYQENNVDQASGSXXXHXEVGDQXWXQVYGEGERNGLYADNDNDSTXTGXXLYHDTN

SEQ ID NO: 721 - protein, 839 aa, Homo sapiens
  SITE (71)..(71): Xaa at position 71 is Ile, Ala, Val, Leu, or Gly
  SITE (134)..(134): Xaa at position 134 is Leu, Ala, Val, Gly, or Ile
  SITE (157)..(157): Xaa at position 157 is Leu, Ala, Val, Gly, or Ile
  SITE (182)..(182): Xaa at position 182 is Leu, Ala, Val, Gly, or Ile
  SITE (298)..(298): Xaa at position 298 is Ala, Gly, or Pro
  SITE (301)..(301): Xaa at position 301 is Val, Ala, Gly, Leu, or Ile
MDVSLCPAKCSFWRIFLLGSVWLDYVGSVLACPANCVCSKTEINCRRPDDGNLFPLLEGQDSGNSNGNASXNITDISRNITSIHIENWRSLHTLNAVDMELYTGLQKLTIKNSGLRSIQPRAFAKNPHLRYINXSSNRLTTLSWQLFQTLSLRELQXEQNFFNCSCDIRWMQLWQEQGEAKXNSQNLYCINADGSQLPLFRMNISQCDLPEISVSHVNLTVREGDNAVITCNGSGSPLPDVDWIVTGLQSINTHQTNLNWTNVHAINLTLVNVTSEDNGFTLTCIAENVVGMSNASVXLTXYYPPRVVSLEEPELRLEHCIEFVVRGNPPPTLHWLHNGQPLRESKIIHVEYYQEGEISEGCLLFNKPTHYNNGNYTLIAKNPLGTANQTINGHFLKEPFPESTDNFILFDEVSPTPPITVTHKPEEDTFGVSIAVGLAAFACVLLVVLFVMINKYGRRSKFGMKGPVAVISGEEDSASPLHHINHGITTPSSLDAGPDTVVIGMTRIPVIENPQYFRQGHNCHKPDTYVQHIKRRDIVLKRELGEGAFGKVFLAECYNLSPTKDKMLVAVKALKDPTLAARKDFQREAELLTNLQHEHIVKFYGVCGDGDPLIMVFEYMKHGDLNKFLRAHGPDAMILVDGQPRQAKGELGLSQMLHIASQIASGMVYLASQHFVHRDLATRNCLVGANLLVKIGDFGMSRDVYSTDYYRLFNPSGNDFCIWCEVGGHTMLPIRWMPPESIMYRKFTTESDVWSFGVILWEIFTYGKQPWFQLSNTEVIECITQGRVLERPRVCPKEVYDVMLGCWQREPQQRLNIKEIYKILHALGKATPIYLDILG

SEQ ID NO: 722 - protein, 729 aa, Homo sapiens
  SITE (653)..(653): Xaa at position 653 is Ile, Ala, Val, Leu, or Gly
  SITE (660)..(660): Xaa at position 660 is Val, Ala, Gly, Leu, or Ile
MNPFQKNESKETLFSPVSIEEVPPRPPSPPKKPSPTICGSNYPLSIAFIVVNEFCERFSYYGMKAVLILYFLYFLHWNEDTSTSIYHAFSSLCYFTPILGAAIADSWLGKFKTIIYLSLVYVLGHVIKSLGALPILGGQVVHTVLSLIGLSLIALGTGGIKPCVAAFGGDQFEEKHAEERTRYFSVFYLSINAGSLISTFITPMLRGDVQCFGEDCYALAFGVPGLLMVIALVVFAMGSKIYNKPPPEGNIVAQVFKCIWFAISNRFKNRSGDIPKRQHWLDWAAEKYPKQLIMDVKALTRVLFLYIPLPMFWALLDQQGSRWTLQAIRMNRNLGFFVLQPDQMQVLNPLLVLIFIPLFDFVIYRLVSKCGINFSSLRKMAVGMILACLAFAVAAAVEIKINEMAPAQPGPQEVFLQVLNLADDEVKVTVVGNENNSLLIESIKSFQKTPHYSKLHLKTKSQDFHFHLKYHNLSLYTEHSVQEKNWYSLVIREDGNSISSMMVKDTESRTTNGMTTVRFVNTLHKDVNISLSTDTSLNVGEDYGVSAYRTVQRGEYPAVHCRTEDKNFSLNLGLLDFGAAYLFVITNNTNQGLQAWKIEDIPANKMSIAWQLPQYALVTAGEVMFSVTGLEFSYSQAPSSMKSVLQAAWLLTXAVGNIIXLVVAQFSGLVQWAEFILFSCLLLVICLIFSIMGYYYVPVKTEDMRGPADKHIPHIQGNMIKLETKKTKL

SEQ ID NO: 723 - protein, 512 aa, Homo sapiens
  SITE (99)..(99): Xaa at position 99 is Phe, Tyr, Met, His, Ile, Leu, Val Ala, or Gly
  SITE (117)..(117): Xaa at position 117 is Leu, Ala, Val, Gly, or Ile
  SITE (190)..(190): Xaa at position 190 is Tyr, Phe, Met, His, Ile, Leu, Val Ala, or Gly
  SITE (217)..(217): Xaa at position 217 is Leu, Ala, Val, Gly, or Ile
  SITE (219)..(219): Xaa at position 219 is Ile, Ala, Val, Leu, or Gly
  SITE (221)..(221): Xaa at position 221 is Leu, Ala, Val, Gly, or Ile
  SITE (248)..(248): Xaa at position 248 is Ile, Ala, Val, Leu, or Gly
  SITE (257)..(257): Xaa at position 257 is Ile, Ala, Val, Leu, or Gly
  SITE (402)..(402): Xaa at position 402 is Ile, Ala, Val, Leu, or Gly
  SITE (428)..(428): Xaa at position 428 is Leu, Ala, Val, Gly, or Ile
  SITE (432)..(432): Xaa at position 432 is Ile, Ala, Val, Leu, or Gly
MDLKESPSEGSLQPSSIQIFANTSTLHGIRHIFVYGPLTIRRVLWAVAFVGSLGLLLVESSERVSYYFSYQHVTKVDEVVAQSLVFPAVTLCNLNGFRXSRLTTNDLYHAGELLALXDVNLQIPDPHLADPSVLEALRQKANFKHYKPKQFSMLEFLHRVGHDLKDMMLYCKFKGQECGHQDFTTVFTKXGKCYMFNSGEDGKPLLTTVKGGTGNGXEXMXDIQQDEYLPIWGETEETTFEAGVKVQXHSQSEPPFXQELGFGVAPGFQTFVATQEQRLTYLPPPWGECRSSEMGLDFFPVYSITACRIDCETRYIVENCNCRMVHMPGDAPFCTPEQHKECAEPALGLLAEKDSNYCLCRTPCNLTRYNKELSMVKIPSKTSAKYLEKKFNKSEKYISENXLVLDIFFEALNYETIEQKKAYEVAAXLGDXGGQMGLFIGASILTILELFDYIYELIKEKLLDLLGKEEDEGSHDENVSTCDTMPNHSETISHTVNVPLQTTLGTLEEIAC

SEQ ID NO: 724 - protein, 155 aa, Homo sapiens
  SITE (94)..(94): Xaa at position 94 is Cys, Ala, Val, Gly, Ser, or Thr
  SITE (99)..(99): Xaa at position 99 is Cys, Ala, Val, Gly, Ser, or Thr
  SITE (121)..(121): Xaa at position 121 is Val, Ala, Gly, Leu, or Ile
MTPGKTSLVSLLLLLSLEAIVKAGITIPRNPGCPNSEDKNFPRTVMVNLNIHNRNTNTNPKRSSDYYNRSTSPWNLHRNEDPERYPSVIWEAKXRHLGXINADGNVDYHMNSVPIQQEILXLRREPPHCPNSFRLEKILVSVGCTCVTPIVHHVA

SEQ ID NO: 725 - protein, 473 aa, Homo sapiens
  SITE (63)..(63): Xaa at position 63 is Cys, Ala, Val, Gly, Ser, or Thr
  SITE (74)..(74): Xaa at position 74 is Leu, Ala, Val, Gly, or Ile
  SITE (117)..(117): Xaa at position 117 is Val, Ala, Gly, Leu, or Ile
  SITE (126)..(126): Xaa at position 126 is Leu, Ala, Val, Gly, or Ile
  SITE (127)..(127): Xaa at position 127 is Phe, Tyr, Met, His, Ile, Leu, Val Ala, or Gly
  SITE (136)..(136): Xaa at position 136 is Tyr, Phe, Met, His, Ile, Leu, Val Ala, or Gly
  SITE (141)..(141): Xaa at position 141 is Ala, Gly, or Pro
  SITE (142)..(142): Xaa at position 142 is Ala, Gly, or Pro
  SITE (144)..(144): Xaa at position 144 is Ala, Gly, or Pro
  SITE (145)..(145): Xaa at position 145 is Val, Ala, Gly, Leu, or Ile
  SITE (149)..(149): Xaa at position 149 is Leu, Ala, Val, Gly, or Ile
  SITE (151)..(151): Xaa at position 151 is Ala, Gly, or Pro
  SITE (165)..(165): Xaa at position 165 is Leu, Ala, Val, Gly, or Ile
  SITE (170)..(170): Xaa at position 170 is Leu, Ala, Val, Gly, or Ile
  SITE (181)..(181): Xaa at position 181 is Leu, Ala, Val, Gly, or Ile
  SITE (183)..(183): Xaa at position 183 is Ile, Ala, Val, Leu, or Gly
  SITE (209)..(209): Xaa at position 209 is Ala, Gly, or Pro
  SITE (222)..(222): Xaa at position 222 is Val, Ala, Gly, Leu, or Ile
  SITE (225)..(225): Xaa at position 225 is Trp, Tyr, Phe, Met, His, Ile, Leu Val, Ala, or Gly
  SITE (227)..(227): Xaa at position 227 is Val, Ala, Gly, Leu, or Ile
  SITE (229)..(229): Xaa at position 229 is Ile, Ala, Val, Leu, or Gly
  SITE (233)..(233): Xaa at position 233 is Ile, Ala, Val, Leu, or Gly
  SITE (234)..(234): Xaa at position 234 is Leu, Ala, Val, Gly, or Ile
  SITE (236)..(236): Xaa at position 236 is Cys, Ala, Val, Gly, Ser, or Thr
  SITE (241)..(241): Xaa at position 241 is Phe, Tyr, Met, His, Ile, Leu, Val Ala, or Gly
  SITE (254)..(254): Xaa at position 254 is Ile, Ala, Val, Leu, or Gly
  SITE (266)..(266): Xaa at position 266 is Trp, Tyr, Phe, Met, His, Ile, Leu Val, Ala, or Gly
  SITE (271)..(271): Xaa at position 271 is Leu, Ala, Val, Gly, or Ile
  SITE (273)..(273): Xaa at position 273 is Ala, Gly, or Pro
  SITE (276)..(276): Xaa at position 276 is Leu, Ala, Val, Gly, or Ile
  SITE (277)..(277): Xaa at position 277 is Val, Ala, Gly, Leu, or Ile
  SITE (280)..(280): Xaa at position 280 is Leu, Ala, Val, Gly, or Ile
  SITE (294)..(294): Xaa at position 294 is Ala, Gly, or Pro
  SITE (299)..(299): Xaa at position 299 is Trp, Tyr, Phe, Met, His, Ile, Leu Val, Ala, or Gly
  SITE (317)..(317): Xaa at position 317 is Leu, Ala, Val, Gly, or Ile
  SITE (320)..(320): Xaa at position 320 is Phe, Tyr, Met, His, Ile, Leu, Val Ala, or Gly
MLKVTVPSCSASSCSSVTASAAPGTASLVPDYWIDGSNRDALSDFFEVESELGRGATSIVYRXKQKGTQKPYAXKVLKKTVDKKIVRTEIGVLLRLSHPNIIKLKEIFETPTEISLXLELVTGGEXXDRIVEKGYXSERDXXDXXKQIXEXVAYLHENGIVHRDXKPENXLYATPAPDAPXKXADFGLSKIVEHQVLMKTVCGTPGYCXPEILRGCAYGPEXDMXSXGXITYXXLXGFEPXYDERGDQFMFRRXLNCEYYFISPWXDEVSXNXKDXXRKXIVLDPKKRLTTFQXLQHPXVTGKAANFVHMDTAQKKXQEXNARRKLKAAVKAVVASSRLGSASSSHGSIQESHKASRDPSPIQDGNEDMKAIPEGEKIQGDGAQAAVKGAQAELMKVQALEKVKGADINAEEAPKMVPKAVEDGIKVADLELEEGLAEEKLKTVEEAAAPREGQGSSAVGFEVPQQDVILPEY

SEQ ID NO: 726 - protein, 3333 aa, Homo sapiens
  SITE (272)..(272): Xaa at position 272 is Leu, Ala, Val, Gly, or Ile
MAAAARPRGRALGPVLPPTPLLLLVLRVLPACGATARDPGAAAGLSLHPTYFNLAEAARIWATATCGERGPGEGRPQPELYCKLVGGPTAPGSGHTIQGQFCDYCNSEDPRKAHPVTNAIDGSERWWQSPPLSSGTQYNRVNLTLDLGQLFHVAYILIKFANSPRPDLWVLERSVDFGSTYSPWQYFAHSKVDCLKEFGREANMAVTRDDDVLCVTEYSRIVPLENGEVVVSLINGRPGAKNFTFSHTLREFTKATNIRLRFLRTNTLLGHXISKAQRDPTVTRRYYYSIKDISIGGQCVCNGHAEVCNINNPEKLFRCECQHHTCGETCDRCCTGYNQRRWRPAAWEQSHECEACNCHGHASNCYYDPDVERQQASLNTQGIYAGGGVCINCQHNTAGVNCEQCAKGYYRPYGVPVDAPDGCIPCSCDPEHADGCEQGSGRCHCKPNFHGDNCEKCAIGYYNFPFCLRIPIFPVSTPSSEDPVAGDIKGCDCNLEGVLPEICDAHGRCLCRPGVEGPRCDTCRSGFYSFPICQACWCSALGSYQMPCSSVTGQCECRPGVTGQRCDRCLSGAYDFPHCQGSSSACDPAGTINSNLGYCQCKLHVEGPTCSRCKLLYWNLDKENPSGCSECKCHKAGTVSGTGECRQGDGDCHCKSHVGGDSCDTCEDGYFALEKSNYFGCQGCQCDIGGALSSMCSGPSGVCQCREHVVGKVCQRPENNYYFPDLHHMKYEIEDGSTPNGRDLRFGFDPLAFPEFSWRGYAQMTSVQNDVRITLNVGKSSGSLFRVILRYVNPGTEAVSGHITIYPSWGAAQSKEIIFLPSKEPAFVTVPGNGFADPFSITPGIWVACIKAEGVLLDYLVLLPRDYYEASVLQLPVTEPCAYAGPPQENCLLYQHLPVTRFPCTLACEARHFLLDGEPRPVAVRQPTPAHPVMVDLSGREVELHLRLRIPQVGHYVVVVEYSTEAAQLFVVDVNVKSSGSVLAGQVNIYSCNYSVLCRSAVIDHMSRIAMYELLADADIQLKGHMARFLLHQVCIIPIEEFSAEYVRPQVHCIASYGRFVNQSATCVSLAHETPPTALILDVLSGRPFPHLPQQSSPSVDVLPGVTLKAPQNQVTLRGRVPHLGRYVFVIHFYQAAHPTFPAQVSVDGGWPRAGSFHASFCPHVLGCRDQVIAEGQIEFDISEPEVAATVKVPEGKSLVLVRVLVVPAENYDYQILHKKSMDKSLEFITNCGKNSFYLDPQTASRFCKNSARSLVAFYHKGALPCECHPTGATGPHCSPEGGQCPCQPNVIGRQCTRCATGHYGFPRCKPCSCGRRLCEEMTGQCRCPPRTVRPQCEVCETHSFSFHPMAGCEGCNCSRRGTIEAAMPECDRDSGQCRCKPRITGRQCDRCASGFYRFPECVPCNCNRDGTEPGVCDPGTGACLCKENVEGTECNVCREGSFHLDPANLKGCTSCFCFGVNNQCHSSHKRRTKFVDMLGWHLETADRVDIPVSFNPGSNSMVADLQELPATIHSASWVAPTSYLGDKVSSYGGYLTYQAKSFGLPGDMVLLEKKPDVQLTGQHMSIIYEETNTPRPDRLHHGRVHVVEGNFRHASSRAPVSREELMTVLSRLADVRIQGLYFTETQRLTLSEVGLEEASDTGSGRIALAVEICACPPAYAGDSCQGCSPGYYRDHKGLYTGRCVPCNCNGHSNQCQDGSGICVNCQHNTAGEHCERCQEGYYGNAVHGSCRACPCPHTNSFATGCVVNGGDVRCSCKAGYTGTQCERCAPGYFGNPQKFGGSCQPCSCNSNGQLGSCHPLTGDCINQEPKDSSPAEECDDCDSCVMTLLNDLATMGEQLRLVKSQLQGLSASAGLLEQMRHMETQAKDLRNQLLNYRSAISNHGSKIEGLERELTDLNQEFETLQEKAQVNSRKAQTLNNNVNRATQSAKELDVKIKNVIRNVHILLKQISGTDGEGNNVPSGDFSREWAEAQRMMRELRNRNFGKHLREAEADKRESQLLLNRIRTWQKTHQGENNGLANSIRDSLNEYEAKLSDLRARLQEAAAQAKQANGLNQENERALGAIQRQVKEINSLQSDFTKYLTTADSSLLQTNIALQLMEKSQKEYEKLAASLNEARQELSDKVRELSRSAGKTSLVEEAEKHARSLQELAKQLEEIKRNASGDELVRCAVDAATAYENILNAIKAAEDAANRAASASESALQTVIKEDLPRKAKTLSSNSDKLLNEAKMTQKKLKQEVSPALNNLQQTLNIVTVQKEVIDTNLTTLRDGLHGIQRGDIDAMISSAKSMVRKANDITDEVLDGLNPIQTDVERIKDTYGRTQNEDFKKALTDADNSVNKLTNKLPDLWRKIESINQQLLPLGNISDNMDRIRELIQQARDAASKVAVPMRFNGKSGVEVRLPNDLEDLKGYTSLSLFLQRPNSRENGGTENMFVMYLGNKDASRDYIGMAVVDGQLTCVYNLGDREAELQVDQILTKSETKEAVMDRVKFQRIYQFARLNYTKGATSSKPETPGVYDMDGRNSNTLLNLDPENVVFYVGGYPPDFKLPSRLSFPPYKGCIELDDLNENVLSLYNFKKTFNLNTTEVEPCRRRKEESDKNYFEGTGYARVPTQPHAPIPTFGQTIQTTVDRGLLFFAENGDRFISLNIEDGKLMVRYKLNSELPKERGVGDAINNGRDHSIQIKIGKLQKRMWINVDVQNTIIDGEVFDFSTYYLGGIPIAIRERFNISTPAFRGCMKNLKKTSGVVRLNDTVGVTKKCSEDWKLVRSASFSRGGQLSFTDLGLPPTDHLQASFGFQTFQPSGILLDHQTWTRNLQVTLEDGYIELSTSDSGSPIFKSPQTYMDGLLHYVSVISDNSGLRLLIDDQLLRNSKRLKHISSSRQSLRLGGSNFEGCISNVFVQRLSLSPEVLDLTSNSLKRDVSLGGCSLNKPPFLMLLKGSTRFNKTKTFRINQLLQDTPVASPRSVKVWQDACSPLPKTQANHGALQFGDIPTSHLLFKLPQELLKPRSQFAVDMQTTSSRGLVFHTGTKNSFMALYLSKGRLVFALGTDGKKLRIKSKEKCNDGKWHTVVFGHDGEKGRLVVDGLRAREGSLPGNSTISIRAPVYLGSPPSGKPKSLPTNSFVGCLKNFQLDSKPLYTPSSSFGVSSCLGGPLEKGIYFSEEGGHVVLAHSVLLGPEFKLVFSIRPRSLTGILIHIGSQPGKHLCVYLEAGKVTASMDSGAGGTSTSVTPKQSLCDGQWHSVAVTIKQHILHLELDTDSSYTAGQIPFPPASTQEPLHLGGAPANLTTLRIPVWKSFFGCLRNIHVNHIPVPVTEALEVQGPVSLNGCPDQ

SEQ ID NO: 727 - protein, 1216 aa, Homo sapiens
  SITE (920)..(920): Xaa at position 920 is Leu, Ala, Val, Gly, or Ile
  SITE (923)..(923): Xaa at position 923 is Phe, Tyr, Met, His, Ile, Leu, Val Ala, or Gly
  SITE (930)..(930): Xaa at position 930 is Met, Ile, Leu, Val, Ala, or Gly
  SITE (938)..(938): Xaa at position 938 is Phe, Tyr, Met, His, Ile, Leu, Val Ala, or Gly
  SITE (942)..(942): Xaa at position 942 is Phe, Tyr, Met, His, Ile, Leu, Val Ala, or Gly
  SITE (945)..(945): Xaa at position 945 is Leu, Ala, Val, Gly, or Ile
  SITE (957)..(957): Xaa at position 957 is Ala, Gly, or Pro
  SITE (974)..(974): Xaa at position 974 is Tyr, Phe, Met, His, Ile, Leu, Val Ala, or Gly
  SITE (979)..(979): Xaa at position 979 is Val, Ala, Gly, Leu, or Ile
  SITE (992)..(992): Xaa at position 992 is Tyr, Phe, Met, His, Ile, Leu, Val Ala, or Gly
  SITE (995)..(995): Xaa at position 995 is Ala, Gly, or Pro
  SITE (998)..(998): Xaa at position 998 is Ile, Ala, Val, Leu, or Gly
  SITE (1007)..(1007): Xaa at position 1007 is Tyr, Phe, Met, His, Ile, Leu Val, Ala, or Gly
  SITE (1008)..(1008): Xaa at position 1008 is Ile, Ala, Val, Leu, or Gly
  SITE (1009)..(1009): Xaa at position 1009 is Ala, Gly, or Pro
  SITE (1021)..(1021): Xaa at position 1021 is Phe, Tyr, Met, His, Ile, Leu Val, Ala, or Gly
  SITE (1022)..(1022): Xaa at position 1022 is Trp, Tyr, Phe, Met, His, Ile Leu, Val, Ala, or Gly
  SITE (1024)..(1024): Xaa at position 1024 is Met, Ile, Leu, Val, Ala, or Gly
  SITE (1025)..(1025): Xaa at position 1025 is Val, Ala, Gly, Leu, or Ile
  SITE (1032)..(1032): Xaa at position 1032 is Ile, Ala, Val, Leu, or Gly
  SITE (1033)..(1033): Xaa at position 1033 is Ile, Ala, Val, Leu, or Gly
  SITE (1034)..(1034): Xaa at position 1034 is Val, Ala, Gly, Leu, or Ile
  SITE (1035)..(1035): Xaa at position 1035 is Met, Ile, Leu, Val, Ala, or Gly
  SITE (1036)..(1036): Xaa at position 1036 is Leu, Ala, Val, Gly, or Ile
  SITE (1047)..(1047): Xaa at position 1047 is Cys, Ala, Val, Gly, Ser, or Thr
  SITE (1050)..(1050): Xaa at position 1050 is Tyr, Phe, Met, His, Ile, Leu Val, Ala, or Gly
  SITE (1065)..(1065): Xaa at position 1065 is Val, Ala, Gly, Leu, or Ile
  SITE (1081)..(1081): Xaa at position 1081 is Phe, Tyr, Met, His, Ile, Leu Val, Ala, or Gly
  SITE (1083)..(1083): Xaa at position 1083 is Ile, Ala, Val, Leu, or Gly
  SITE (1092)..(1092): Xaa at position 1092 is Val, Ala, Gly, Leu, or Ile
  SITE (1094)..(1094): Xaa at position 1094 is His, Phe, Tyr, Lys, Arg, Gly Ser, Thr, Ala, Val, Leu, Ile, Asn, Met, or Gln
  SITE (1097)..(1097): Xaa at position 1097 is Tyr, Phe, Met, His, Ile, Leu Val, Ala, or Gly
  SITE (1100)..(1100): Xaa at position 1100 is Trp, Tyr, Phe, Met, His, Ile Leu, Val, Ala, or Gly
  SITE (1114)..(1114): Xaa at position 1114 is Ile, Ala, Val, Leu, or Gly
  SITE (1117)..(1117): Xaa at position 1117 is Phe, Tyr, Met, His, Ile, Leu Val, Ala, or Gly
  SITE (1118)..(1118): Xaa at position 1118 is Val, Ala, Gly, Leu, or Ile
  SITE (1121)..(1121): Xaa at position 1121 is Val, Ala, Gly, Leu, or Ile
  SITE (1132)..(1132): Xaa at position 1132 is Met, Ile, Leu, Val, Ala, or Gly
  SITE (1133)..(1133): Xaa at position 1133 is Ile, Ala, Val, Leu, or Gly
  SITE (1134)..(1134): Xaa at position 1134 is Ile, Ala, Val, Leu, or Gly
  SITE (1135)..(1135): Xaa at position 1135 is His, Phe, Tyr, Lys, Arg, Gly Ser, Thr, Ala, Val, Leu, Ile, Asn, Met, or Gln
  SITE (1136)..(1136): Xaa at position 1136 is Cys, Ala, Val, Gly, Ser, or Thr
  SITE (1140)..(1140): Xaa at position 1140 is Val, Ala, Gly, Leu, or Ile
  SITE (1146)..(1146): Xaa at position 1146 is Phe, Tyr, Met, His, Ile, Leu Val, Ala, or Gly
  SITE (1147)..(1147): Xaa at position 1147 is Ile, Ala, Val, Leu, or Gly
  SITE (1148)..(1148): Xaa at position 1148 is Ala, Gly, or Pro
  SITE (1149)..(1149): Xaa at position 1149 is Leu, Ala, Val, Gly, or Ile
  SITE (1152)..(1152): Xaa at position 1152 is Leu, Ala, Val, Gly, or Ile
  SITE (1162)..(1162): Xaa at position 1162 is Val, Ala, Gly, Leu, or Ile
  SITE (1164)..(1164): Xaa at position 1164 is Ile, Ala, Val, Leu, or Gly
  SITE (1165)..(1165): Xaa at position 1165 is Leu, Ala, Val, Gly, or Ile
  SITE (1168)..(1168): Xaa at position 1168 is Val, Ala, Gly, Leu, or Ile
  SITE (1171)..(1171): Xaa at position 1171 is Met, Ile, Leu, Val, Ala, or Gly
  SITE (1178)..(1178): Xaa at position 1178 is Met, Ile, Leu, Val, Ala, or Gly
  SITE (1179)..(1179): Xaa at position 1179 is Val, Ala, Gly, Leu, or Ile
  SITE (1185)..(1185): Xaa at position 1185 is Tyr, Phe, Met, His, Ile, Leu Val, Ala, or Gly
  SITE (1187)..(1187): Xaa at position 1187 is Phe, Tyr, Met, His, Ile, Leu Val, Ala, or Gly
  SITE (1188)..(1188): Xaa at position 1188 is Ile, Ala, Val, Leu, or Gly
  SITE (1191)..(1191): Xaa at position 1191 is Cys, Ala, Val, Gly, Ser, or Thr
  SITE (1192)..(1192): Xaa at position 1192 is Val, Ala, Gly, Leu, or Ile
MGHLPTGIHGARRLLPLLWLFVLFKNATAFHVTVQDDNNIVVSLEASDVISPASVYVVKITGESKNYFFEFEEFNSTLPPPVIFKASYHGLYYIITLVVVNGNVVTKPSRSITVLTKPLPVTSVSIYDYKPSPETGVLFEIHYPEKYNVFTRVNISYWEGKDFRTMLYKDFFKGKTVFNHWLPGMCYSNITFQLVSEATFNKSTLVEYSGVSHEPKQHRTAPYPPQNISVRIVNLNKNNWEEQSGNFPEESFMRSQDTIGKEKLFHFTEETPEIPSGNISSGWPDFNSSDYETTSQPYWWDSASAAPESEDEFVSVLPMEYENNSTLSETEKSTSGSFSFFPVQMILTWLPPKPPTAFDGFHIHIEREENFTEYLMVDEEAHEFVAELKEPGKYKLSVTTFSSSGSCETRKSQSAKSLSFYISPSGEWIEELTEKPQHVSVHVLSSTTALMSWTSSQENYNSTIVSVVSLTCQKQKESQRLEKQYCTQVNSSKPIIENLVPGAQYQVVIYLRKGPLIGPPSDPVTFAIVPTGIKDLMLYPLGPTAVVLSWTRPYLGVFRKYVVEMFYFNPATMTSEWTTYYEIAATVSLTASVRIANLLPAWYYNFRVTMVTWGDPELSCCDSSTISFITAPVAPEITSVEYFNSLLYISWTYGDDTTDLSHSRMLHWMVVAEGKKKIKKSVTRNVMTAILSLPPGDIYNLSVTACTERGSNTSMLRLVKLEPAPPKSLFAVNKTQTSVTLLWVEEGVADFFEVFCQQVGSSQKTKLQEPVAVSSHVVTISSLLPATAYNCSVTSFSHDSPSVPTFIAVSTMVTEMNPNVVVISVLAILSTLLIGLLLVTLIILRKKHLQMARECGAGTFVNFASLERDGKLPYNWRRSIFAFLTLLPSCLWTDYLLAFYINPWSKNGLKKRKLTNPVQXDDXDAYIKDXAKDSDYKXSLQXEEXKLIGLDIPHFAXDLPLNRCKNRYTNILPXDFSRXRLVSMNEEEGADXINXNYXPGYNSPQEXXXTQGPLPETRNDXXKXXLQQKSQXXXXXTQCNEKRRVKXDHXWPFTEEPIAYGDITXEMISEEEQDDWACRHXRXNYADEMQDXMXFNXTAXPDHGVPTANAAESXLQXXHMXRQQATKSKGPXXXXXSAGXGRTGTXXXXDRXLQHIRDHEFXDXXGLXSEXRSYRMSXXQTEEQXIXXHQXXQLMWMKKKQQFCISDVIYENVSKS

SEQ ID NO: 728 - protein, 2366 aa, Peptoclostridium difficile
  strain 630 (Clostridium difficile)
  SITE (562)..(562): Xaa at position 562 is Leu, Ala, Val, Gly, or Ile
  SITE (578)..(578): Xaa at position 578 is Ile, Ala, Val, Leu, or Gly
  SITE (580)..(580): Xaa at position 580 is Tyr, Phe, Met, His, Ile, Leu, Val Ala, or Gly
  SITE (581)..(581): Xaa at position 581 is Ile, Ala, Val, Leu, or Gly
  SITE (582)..(582): Xaa at position 582 is Val, Ala, Gly, Leu, or Ile
  SITE (594)..(594): Xaa at position 594 is Ala, Gly, or Pro
  SITE (598)..(598): Xaa at position 598 is Phe, Tyr, Met, His, Ile, Leu, Val Ala, or Gly
  SITE (599)..(599): Xaa at position 599 is Ala, Gly, or Pro
  SITE (606)..(606): Xaa at position 606 is Val, Ala, Gly, Leu, or Ile
  SITE (607)..(607): Xaa at position 607 is Leu, Ala, Val, Gly, or Ile
  SITE (608)..(608): Xaa at position 608 is Phe, Tyr, Met, His, Ile, Leu, Val Ala, or Gly
  SITE (618)..(618): Xaa at position 618 is Ala, Gly, or Pro
  SITE (648)..(648): Xaa at position 648 is Leu, Ala, Val, Gly, or Ile
  SITE (650)..(650): Xaa at position 650 is Phe, Tyr, Met, His, Ile, Leu, Val Ala, or Gly
  SITE (663)..(663): Xaa at position 663 is Phe, Tyr, Met, His, Ile, Leu, Val Ala, or Gly
  SITE (671)..(671): Xaa at position 671 is Leu, Ala, Val, Gly, or Ile
  SITE (675)..(675): Xaa at position 675 is Ile, Ala, Val, Leu, or Gly
  SITE (686)..(686): Xaa at position 686 is Ile, Ala, Val, Leu, or Gly
  SITE (693)..(693): Xaa at position 693 is Ile, Ala, Val, Leu, or Gly
  SITE (695)..(695): Xaa at position 695 is Leu, Ala, Val, Gly, or Ile
  SITE (700)..(700): Xaa at position 700 is Met, Ile, Leu, Val, Ala, or Gly
  SITE (701)..(701): Xaa at position 701 is Phe, Tyr, Met, His, Ile, Leu, Val Ala, or Gly
  SITE (711)..(711): Xaa at position 711 is Tyr, Phe, Met, His, Ile, Leu, Val Ala, or Gly
  SITE (715)..(715): Xaa at position 715 is Leu, Ala, Val, Gly, or Ile
  SITE (716)..(716): Xaa at position 716 is Leu, Ala, Val, Gly, or Ile
  SITE (719)..(719): Xaa at position 719 is Val, Ala, Gly, Leu, or Ile
  SITE (723)..(723): Xaa at position 723 is Ile, Ala, Val, Leu, or Gly
  SITE (727)..(727): Xaa at position 727 is Met, Ile, Leu, Val, Ala, or Gly
  SITE (735)..(735): Xaa at position 735 is Ile, Ala, Val, Leu, or Gly
  SITE (737)..(737): Xaa at position 737 is Val, Ala, Gly, Leu, or Ile
  SITE (739)..(739): Xaa at position 739 is Ala, Gly, or Pro
  SITE (762)..(762): Xaa at position 762 is Ile, Ala, Val, Leu, or Gly
  SITE (778)..(778): Xaa at position 778 is Ile, Ala, Val, Leu, or Gly
MSLVNRKQLEKMANVRFRTQEDEYVAILDALEEYHNMSENTVVEKYLKLKDINSLTDIYIDTYKKSGRNKALKKFKEYLVTEVLELKNNNLTPVEKNLHFVWIGGQINDTAINYINQWKDVNSDYNVNVFYDSNAFLINTLKKTVVESAINDTLESFRENLNDPRFDYNKFFRKRMEIIYDKQKNFINYYKAQREENPELIIDDIVKTYLSNEYSKEIDELNTYIEESLNKITQNSGNDVRNFEEFKNGESFNLYEQELVERWNLAAASDILRISALKEIGGMYLDVDMLPGIQPDLFESIEKPSSVTVDFWEMTKLEAIMKYKEYIPEYTSEHFDMLDEEVQSSFESVLASKSDKSEIFSSLGDMEASPLEVKIAFNSKGIINQGLISVKDSYCSNLIVKQIENRYKILNNSLNPAISEDNDFNTTTNTFIDSIMAEANADNGRFMMELGKYLRVGFFPDVKTTINLSGPEAYAAAYQDLLMFKEGSMNIHLIEADLRNFEISKTNISQSTEQEMASLWSFDDARAKAQFEEYKRNYFEGSLGEDDNLDFSQNIVVDKEYXLEKISSLARSSERGYXHXXXQLQGDKISYEAXCNLXXKTPYDSXXXQKNIEDSEIXYYYNPGDGEIQEIDKYKIPSIISDRPKIKXTXIGHGKDEFNTDIXAGFDVDSXSTEXEAAIDLAKEDXSPKSIEXNXLGCNXXSYSINVEETXPGKXXLKXKDKXSELXPSISQDSXIXSXNQYEVRINSEGRRELLDHSGEWXNKEESIIKDISSKEYXSFNPKENKITVKSKNLPELSTLLQEIRNNSNSSDIELEEKVMLTECEINVISNIDTQIVEERIEEAKNLTSDSINYIKDEFKLIESISDALCDLKQQNELEDSHFISFEDISETDEGFSIRFINKETGESIFVETEKTIFSEYANHITEEISKIKGTIFDTVNGKLVKKVNLDTTHEVNTLNAAFFIQSLIEYNSSKESLSNLSVAMKVQVYAQLFSTGLNTITDAAKVVELVSTALDETIDLLPTLSEGLPIIATIIDGVSLGAAIKELSETSDPLLRQEIEAKIGIMAVNLTTATTAIITSSLGIASGFSILLVPLAGISAGIPSLVNNELVLRDKATKVVDYFKHVSLVETEGVFTLLDDKIMMPQDDLVISEIDFNNNSIVLGKCEIWRMEGGSGHTVTDDIDHFFSAPSITYREPHLSIYDVLEVQKEELDLSKDLMVLPNAPNRVFAWETGWTPGLRSLENDGTKLLDRIRDNYEGEFYWRYFAFIADALITTLKPRYEDTNIRINLDSNTRSFIVPIITTEYIREKLSYSFYGSGGTYALSLSQYNMGINIELSESDVWIIDVDNVVRDVTIESDKIKKGDLIEGILSTLSIEENKIILNSHEINFSGEVNGSNGFVSLTFSILEGINAIIEVDLLSKSYKLLISGELKILMLNSNHIQQKIDYIGFNSELQKNIPYSFVDSEGKENGFINGSTKEGLFVSELPDVVLISKVYMDDSKPSFGYYSNNLKDVKVITKDNVNILTGYYLKDDIKISLSLTLQDEKTIKLNSVHLDESGVAEILKFMNRKGNTNTSDSLMSFLESMNIKSIFVNFLQSNIKFILDANFIISGTTSIGQFEFICDENDNIQPYFIKFNTLETNYTLYVGNRQNMIVEPNYDLDDSGDISSTVINFSQKYLYGIDSCVNKVVISPNIYTDEINITPVYETNNTYPEVIVLDANYINEKINVNINDLSIRYVWSNDGNDFILMSTSEENKVSQVKIRFVNVFKDKTLANKLSFNFSDKQDVPVSEIILSFTPSYYEDGLIGYDLGLVSLYNEKFYINNFGMMVSGLIYINDSLYYFKPPVNNLITGFVTVGDDKYYFNPINGGAASIGETIIDDKNYYFNQSGVLQTGVFSTEDGFKYFAPANTLDENLEGEAIDFTGKLIIDENIYYFDDNYRGAVEWKELDGEMHYFSPETGKAFKGLNQIGDYKYYFNSDGVMQKGFVSINDNKHYFDDSGVMKVGYTEIDGKHFYFAENGEMQIGVFNTEDGFKYFAHHNEDLGNEEGEEISYSGILNFNNKIYYFDDSFTAVVGWKDLEDGSKYYFDEDTAEAYIGLSLINDGQYYFNDDGIMQVGFVTINDKVFYFSDSGIIESGVQNIDDNYFYIDDNGIVQIGVFDTSDGYKYFAPANTVNDNIYGQAVEYSGLVRVGEDVYYFGETYTIETGWIYDMENESDKYYFNPETKKACKGINLIDDIKYYFDEKGIMRTGLISFENNNYYFNENGEMQFGYINIEDKMFYFGEDGVMQIGVFNTPDGFKYFAHQNTLDENFEGESINYTGWLDLDEKRYYFTDEYIAATGSVIIDGEEYYFDPDTAQLVISE

SEQ ID NO: 729 - protein, 2710 aa, Peptoclostridium difficile
  strain 630 (Clostridium difficile)
  SITE (9)..(9): Xaa at position 9 is Leu, Ala, Val, Gly, or Ile
  SITE (13)..(13): Xaa at position 13 is Ala, Gly, or Pro
  SITE (23)..(23): Xaa at position 23 is Tyr, Phe, Met, His, Ile, Leu, Val Ala, or Gly
  SITE (26)..(26): Xaa at position 26 is Ile, Ala, Val, Leu, or Gly
  SITE (30)..(30): Xaa at position 30 is Leu, Ala, Val, Gly, or Ile
  SITE (48)..(48): Xaa at position 48 is Leu, Ala, Val, Gly, or Ile
  SITE (51)..(51): Xaa at position 51 is Leu, Ala, Val, Gly, or Ile
  SITE (55)..(55): Xaa at position 55 is Ile, Ala, Val, Leu, or Gly
  SITE (58)..(58): Xaa at position 58 is Phe, Tyr, Met, His, Ile, Leu, Val Ala, or Gly
  SITE (71)..(71): Xaa at position 71 is Leu, Ala, Val, Gly, or Ile
  SITE (74)..(74): Xaa at position 74 is Leu, Ala, Val, Gly, or Ile
  SITE (78)..(78): Xaa at position 78 is Ile, Ala, Val, Leu, or Gly
  SITE (82)..(82): Xaa at position 82 is Val, Ala, Gly, Leu, or Ile
  SITE (97)..(97): Xaa at position 97 is Leu, Ala, Val, Gly, or Ile
  SITE (98)..(98): Xaa at position 98 is His, Phe, Tyr, Lys, Arg, Gly, Ser Thr, Ala, Val, Leu, Ile, Asn, Met, or Gln
  SITE (99)..(99): Xaa at position 99 is Phe, Tyr, Met, His, Ile, Leu, Val Ala, or Gly
  SITE (106)..(106): Xaa at position 106 is Val, Ala, Gly, Leu, or Ile
  SITE (113)..(113): Xaa at position 113 is Tyr, Phe, Met, His, Ile, Leu, Val Ala, or Gly
  SITE (117)..(117): Xaa at position 117 is Trp, Tyr, Phe, Met, His, Ile, Leu Val, Ala, or Gly
  SITE (128)..(128): Xaa at position 128 is Leu, Ala, Val, Gly, or Ile
  SITE (129)..(129): Xaa at position 129 is Trp, Tyr, Phe, Met, His, Ile, Leu Val, Ala, or Gly
  SITE (134)..(134): Xaa at position 134 is Ala, Gly, or Pro
  SITE (135)..(135): Xaa at position 135 is Phe, Tyr, Met, His, Ile, Leu, Val Ala, or Gly
  SITE (136)..(136): Xaa at position 136 is Leu, Ala, Val, Gly, or Ile
  SITE (152)..(152): Xaa at position 152 is Ala, Gly, or Pro
  SITE (170)..(170): Xaa at position 170 is Phe, Tyr, Met, His, Ile, Leu, Val Ala, or Gly
  SITE (171)..(171): Xaa at position 171 is Tyr, Phe, Met, His, Ile, Leu, Val Ala, or Gly
  SITE (175)..(175): Xaa at position 175 is Met, Ile, Leu, Val, Ala, or Gly
  SITE (178)..(178): Xaa at position 178 is Ile, Ala, Val, Leu, or Gly
  SITE (204)..(204): Xaa at position 204 is Ile, Ala, Val, Leu, or Gly
  SITE (205)..(205): Xaa at position 205 is Ile, Ala, Val, Leu, or Gly
  SITE (209)..(209): Xaa at position 209 is Leu, Ala, Val, Gly, or Ile
  SITE (231)..(231): Xaa at position 231 is Ile, Ala, Val, Leu, or Gly
  SITE (239)..(239): Xaa at position 239 is Ile, Ala, Val, Leu, or Gly
  SITE (244)..(244): Xaa at position 244 is Leu, Ala, Val, Gly, or Ile
  SITE (254)..(254): Xaa at position 254 is Tyr, Phe, Met, His, Ile, Leu, Val Ala, or Gly
  SITE (258)..(258): Xaa at position 258 is Leu, Ala, Val, Gly, or Ile
  SITE (266)..(266): Xaa at position 266 is Ala, Gly, or Pro
  SITE (267)..(267): Xaa at position 267 is Ala, Gly, or Pro
  SITE (271)..(271): Xaa at position 271 is Val, Ala, Gly, Leu, or Ile
  SITE (275)..(275): Xaa at position 275 is Ala, Gly, or Pro
  SITE (276)..(276): Xaa at position 276 is Leu, Ala, Val, Gly, or Ile
  SITE (282)..(282): Xaa at position 282 is Val, Ala, Gly, Leu, or Ile
  SITE (284)..(284): Xaa at position 284 is Leu, Ala, Val, Gly, or Ile
  SITE (288)..(288): Xaa at position 288 is Met, Ile, Leu, Val, Ala, or Gly
  SITE (289)..(289): Xaa at position 289 is Leu, Ala, Val, Gly, or Ile
  SITE (314)..(314): Xaa at position 314 is Ile, Ala, Val, Leu, or Gly
  SITE (316)..(316): Xaa at position 316 is Leu, Ala, Val, Gly, or Ile
  SITE (318)..(318): Xaa at position 318 is Ala, Gly, or Pro
  SITE (319)..(319): Xaa at position 319 is Ile, Ala, Val, Leu, or Gly
  SITE (334)..(334): Xaa at position 334 is Phe, Tyr, Met, His, Ile, Leu, Val Ala, or Gly
  SITE (345)..(345): Xaa at position 345 is Phe, Tyr, Met, His, Ile, Leu, Val Ala, or Gly
  SITE (349)..(349): Xaa at position 349 is Ile, Ala, Val, Leu, or Gly
  SITE (358)..(358): Xaa at position 358 is Ile, Ala, Val, Leu, or Gly
  SITE (359)..(359): Xaa at position 359 is Phe, Tyr, Met, His, Ile, Leu, Val Ala, or Gly
  SITE (367)..(367): Xaa at position 367 is Val, Ala, Gly, Leu, or Ile
  SITE (370)..(370): Xaa at position 370 is Leu, Ala, Val, Gly, or Ile
  SITE (372)..(372): Xaa at position 372 is Ile, Ala, Val, Leu, or Gly
  SITE (374)..(374): Xaa at position 374 is Ile, Ala, Val, Leu, or Gly
  SITE (375)..(375): Xaa at position 375 is Ala, Gly, or Pro
  SITE (385)..(385): Xaa at position 385 is Ala, Gly, or Pro
  SITE (386)..(386): Xaa at position 386 is Leu, Ala, Val, Gly, or Ile
  SITE (387)..(387): Xaa at position 387 is Ile, Ala, Val, Leu, or Gly
  SITE (394)..(394): Xaa at position 394 is Leu, Ala, Val, Gly, or Ile
  SITE (398)..(398): Xaa at position 398 is Val, Ala, Gly, Leu, or Ile
  SITE (406)..(406): Xaa at position 406 is Tyr, Phe, Met, His, Ile, Leu, Val Ala, or Gly
  SITE (409)..(409): Xaa at position 409 is Leu, Ala, Val, Gly, or Ile
  SITE (413)..(413): Xaa at position 413 is Leu, Ala, Val, Gly, or Ile
  SITE (416)..(416): Xaa at position 416 is Ala, Gly, or Pro
  SITE (430)..(430): Xaa at position 430 is Phe, Tyr, Met, His, Ile, Leu, Val Ala, or Gly
  SITE (434)..(434): Xaa at position 434 is Leu, Ala, Val, Gly, or Ile
  SITE (446)..(446): Xaa at position 446 is Leu, Ala, Val, Gly, or Ile
  SITE (449)..(449): Xaa at position 449 is Ile, Ala, Val, Leu, or Gly
  SITE (457)..(457): Xaa at position 457 is Phe, Tyr, Met, His, Ile, Leu, Val Ala, or Gly
  SITE (461)..(461): Xaa at position 461 is Ala, Gly, or Pro
  SITE (467)..(467): Xaa at position 467 is Leu, Ala, Val, Gly, or Ile
  SITE (472)..(472): Xaa at position 472 is Ala, Gly, or Pro
  SITE (473)..(473): Xaa at position 473 is Tyr, Phe, Met, His, Ile, Leu, Val Ala, or Gly
  SITE (476)..(476): Xaa at position 476 is Ala, Gly, or Pro
  SITE (477)..(477): Xaa at position 477 is Tyr, Phe, Met, His, Ile, Leu, Val Ala, or Gly
  SITE (480)..(480): Xaa at position 480 is Phe, Tyr, Met, His, Ile, Leu, Val Ala, or Gly
  SITE (483)..(483): Xaa at position 483 is Leu, Ala, Val, Gly, or Ile
  SITE (497)..(497): Xaa at position 497 is Leu, Ala, Val, Gly, or Ile
  SITE (526)..(526): Xaa at position 526 is Ala, Gly, or Pro
MSLISKEEXIKLXYSIRPRENEXKTXLTNXDEYNKLTTNNNENKYLQXKKXNESXDVXMNKYKTSSRNRAXSNXKKDXLKEXILIKNSNTSPVEKNXXXVWIGGEXSDIALEXIKQXADINAEYNIKXXYDSEXXXVNTLKKAIVESSTTEXLQLLEEEIQNPQFDNMKXXKKRXEFXYDRQKRFINYYKSQINKPTVPTIDDXXKSHXVSEYNRDETVLESYRTNSLRKXNSNHGIDXRANSXFTEQELLNIXSQEXLNRGNLAXXSDIXRLLXXKNFGGXYXDVDXXPGIHSDLFKTISRPSSIGLDRWEMXKXEXXMKYKKYINNYTSENXDKLDQQLKDNXKLIXESKSEKSEXXSKLENLNXSDXEXKXXFALGSVINQXXXSKQGSYXTNLXIEQVKNRXQFXNQHXNPXIESDNNFTDTTKIXHDSXFNSATAENSMFXTKXAPYLQVGXMPEXRSTISXSGPGXXASXXYDXINXQENTIEKTLKASDXIEFKFPENNLSQLTEQEINSLWSFDQASXKYQFEKYVRDYTGGSLSEDNGVDFNKNTALDKNYLLNNKIPSNNVEEAGSKNYVHYIIQLQGDDISYEATCNLFSKNPKNSIIIQRNMNESAKSYFLSDDGESILELNKYRIPERLKNKEKVKVTFIGHGKDEFNTSEFARLSVDSLSNEISSFLDTIKLDISPKNVEVNLLGCNMFSYDFNVEETYPGKLLLSIMDKITSTLPDVNKNSITIGANQYEVRINSEGRKELLAHSGKWINKEEAIMSDLSSKEYIFFDSIDNKLKAKSKNIPGLASISEDIKTLLLDASVSPDTKFILNNLKLNIESSIGDYIYYEKLEPVKNIIHNSIDDLIDEFNLLENVSDELYELKKLNNLDEKYLISFEDISKNNSTYSVRFINKSNGESVYVETEKEIFSKYSEHITKEISTIKNSIITDVNGNLLDNIQLDHTSQVNTLNAAFFIQSLIDYSSNKDVLNDLSTSVKVQLYAQLFSTGLNTIYDSIQLVNLISNAVNDTINVLPTITEGIPIVSTILDGINLGAAIKELLDEHDPLLKKELEAKVGVLAINMSLSIAATVASIVGIGAEVTIFLLPIAGISAGIPSLVNNELILHDKATSVVNYFNHLSESKKYGPLKTEDDKILVPIDDLVISEIDFNNNSIKLGTCNILAMEGGSGHTVTGNIDHFFSSPSISSHIPSLSIYSAIGIETENLDFSKKIMMLPNAPSRVFWWETGAVPGLRSLENDGTRLLDSIRDLYPGKFYWRFYAFFDYAITTLKPVYEDTNIKIKLDKDTRNFIMPTITTNEIRNKLSYSFDGAGGTYSLLLSSYPISTNINLSKDDLWIFNIDNEVREISIENGTIKKGKLIKDVLSKIDINKNKLIIGNQTIDFSGDIDNKDRYIFLTCELDDKISLIIEINLVAKSYSLLLSGDKNYLISNLSNIIEKINTLGLDSKNIAYNYTDESNNKYFGAISKTSQKSIIHYKKDSKNILEFYNDSTLEFNSKDFIAEDINVFMKDDINTITGKYYVDNNTDKSIDFSISLVSKNQVKVNGLYLNESVYSSYLDFVKNSDGHHNTSNFMNLFLDNISFWKLFGFENINFVIDKYFTLVGKTNLGYVEFICDNNKNIDIYFGEWKTSSSKSTIFSGNGRNVVVEPIYNPDTGEDISTSLDFSYEPLYGIDRYINKVLIAPDLYTSLININTNYYSNEYYPEIIVLNPNTFHKKVNINLDSSSFEYKWSTEGSDFILVRYLEESNKKILQKIRIKGILSNTQSFNKMSIDFKDIKKLSLGYIMSNFKSFNSENELDRDHLGFKIIDNKTYYYDEDSKLVKGLININNSLFYFDPIEFNLVTGWQTINGKKYYFDINTGAALISYKIINGKHFYFNNDGVMQLGVFKGPDGFEYFAPANTQNNNIEGQAIVYQSKFLTLNGKKYYFDNDSKAVTGWRIINNEKYYFNPNNAIAAVGLQVIDNNKYYFNPDTAIISKGWQTVNGSRYYFDTDTAIAFNGYKTIDGKHFYFDSDCVVKIGVFSTSNGFEYFAPANTYNNNIEGQAIVYQSKFLTLNGKKYYFDNNSKAVTGWQTIDSKKYYFNTNTAEAATGWQTIDGKKYYFNTNTAEAATGWQTIDGKKYYFNTNTAIASTGYTIINGKHFYFNTDGIMQIGVFKGPNGFEYFAPANTDANNIEGQAILYQNEFLTLNGKKYYFGSDSKAVTGWRIINNKKYYFNPNNAIAAIHLCTINNDKYYFSYDGILQNGYITIERNNFYFDANNESKMVTGVFKGPNGFEYFAPANTHNNNIEGQAIVYQNKFLTLNGKKYYFDNDSKAVTGWQTIDGKKYYFNLNTAEAATGWQTIDGKKYYFNLNTAEAATGWQTIDGKKYYFNTNTFIASTGYTSINGKHFYFNTDGIMQIGVFKGPNGFEYFAPANTHNNNIEGQAILYQNKFLTLNGKKYYFGSDSKAVTGLRTIDGKKYYFNTNTAVAVTGWQTINGKKYYFNTNTSIASTGYTIISGKHFYFNTDGIMQIGVFKGPDGFEYFAPANTDANNIEGQAIRYQNRFLYLHDNIYYFGNNSKAATGWVTIDGNRYYFEPNTAMGANGYKTIDNKNFYFRNGLPQIGVFKGSNGFEYFAPANTDANNIEGQAIRYQNRFLHLLGKIYYFGNNSKAVTGWQTINGKVYYFMPDTAMAAAGGLFEIDGVIYFFGVDGVKAPGIYG

SEQ ID NO: 730 - protein, 504 aa, Homo sapiens
  SITE (7)..(7): Xaa at position 7 is Val, Ala, Gly, Leu, or Ile
MTEAALXEGQVKLRDGKKWKSRWLVLRKPSPVADCLLMLVYKDKSERIKGLRERSSLTLEDICGLEPGLPYEGLVHTLAIVCLSQAIMLGFDSHEAMCAWDARIRYALGEVHRFHVTVAPGTKLESGPATLHLCNDVLVLARDIPPAVTGQWKLSDLRRYGAVPSGFIFEGGTRCGYWAGVFFLSSAEGEQISFLFDCIVRGISPTKGPFGLRPVLPDPSPPGPSTVEERVAQEALETLQLEKRLSLLSHAGRPGSGGDDRSLSSSSSEASHLDVSASSRLTAWPEQSSSSASTSQEGPRPAAAQAAGEAMVGASRPPPKPLRPRQLQEVGRQSSSDSGIATGSHSSYSSSLSSYAGSSLDVWRATDELGSLLSLPAAGAPEPSLCTCLPGTVEYQVPTSLRAHYDTPRSLCLAPRDHSPPSQGSPGNSAARDSGGQTSAGCPSGWLGTRRRGLVMEAPQGSEATLPGPAPGEPWEAGGPHAGPPPAFFSACPVCGGLKVNPPP

SEQ ID NO: 731 - protein, 893 aa, Bovine coronavirus
  SITE (60)..(60): Xaa at position 60 is Tyr, Phe, Met, His, Ile, Leu, Val Ala, or Gly
  SITE (70)..(70): Xaa at position 70 is Met, Ile, Leu, Val, Ala, or Gly
  SITE (78)..(78): Xaa at position 78 is Leu, Ala, Val, Gly, or Ile
  SITE (83)..(83): Xaa at position 83 is Phe, Tyr, Met, His, Ile, Leu, Val Ala, or Gly
  SITE (91)..(91): Xaa at position 91 is Phe, Tyr, Met, His, Ile, Leu, Val Ala, or Gly
  SITE (96)..(96): Xaa at position 96 is Phe, Tyr, Met, His, Ile, Leu, Val Ala, or Gly
  SITE (97)..(97): Xaa at position 97 is Ala, Gly, or Pro
  SITE (99)..(99): Xaa at position 99 is Val, Ala, Gly, Leu, or Ile
  SITE (114)..(114): Xaa at position 114 is Phe, Tyr, Met, His, Ile, Leu, Val Ala, or Gly
  SITE (116)..(116): Xaa at position 116 is Ala, Gly, or Pro
  SITE (117)..(117): Xaa at position 117 is Ile, Ala, Val, Leu, or Gly
  SITE (119)..(119): Xaa at position 119 is Ile, Ala, Val, Leu, or Gly
  SITE (123)..(123): Xaa at position 123 is Phe, Tyr, Met, His, Ile, Leu, Val Ala, or Gly
  SITE (130)..(130): Xaa at position 130 is Val, Ala, Gly, Leu, or Ile
  SITE (131)..(131): Xaa at position 131 is Val, Ala, Gly, Leu, or Ile
  SITE (147)..(147): Xaa at position 147 is Leu, Ala, Val, Gly, or Ile
  SITE (149)..(149): Xaa at position 149 is Ile, Ala, Val, Leu, or Gly
  SITE (151)..(151): Xaa at position 151 is Val, Ala, Gly, Leu, or Ile
  SITE (152)..(152): Xaa at position 152 is Cys, Ala, Val, Gly, Ser, or Thr
  SITE (156)..(156): Xaa at position 156 is Met, Ile, Leu, Val, Ala, or Gly
  SITE (157)..(157): Xaa at position 157 is Cys, Ala, Val, Gly, Ser, or Thr
  SITE (161)..(161): Xaa at position 161 is His, Phe, Tyr, Lys, Arg, Gly, Ser Thr, Ala, Val, Leu, Ile, Asn, Met, or Gln
  SITE (163)..(163): Xaa at position 163 is Ile, Ala, Val, Leu, or Gly
  SITE (200)..(200): Xaa at position 200 is Leu, Ala, Val, Gly, or Ile
  SITE (203)..(203): Xaa at position 203 is His, Phe, Tyr, Lys, Arg, Gly, Ser Thr, Ala, Val, Leu, Ile, Asn, Met, or Gln
  SITE (204)..(204): Xaa at position 204 is Phe, Tyr, Met, His, Ile, Leu, Val Ala, or Gly
  SITE (211)..(211): Xaa at position 211 is Phe, Tyr, Met, His, Ile, Leu, Val Ala, or Gly
  SITE (213)..(213): Xaa at position 213 is Ala, Gly, or Pro
  SITE (224)..(224): Xaa at position 224 is Phe, Tyr, Met, His, Ile, Leu, Val Ala, or Gly
  SITE (238)..(238): Xaa at position 238 is Tyr, Phe, Met, His, Ile, Leu, Val Ala, or Gly
  SITE (239)..(239): Xaa at position 239 is Val, Ala, Gly, Leu, or Ile
  SITE (240)..(240): Xaa at position 240 is Leu, Ala, Val, Gly, or Ile
  SITE (242)..(242): Xaa at position 242 is Leu, Ala, Val, Gly, or Ile
  SITE (244)..(244): Xaa at position 244 is Cys, Ala, Val, Gly, Ser, or Thr
  SITE (252)..(252): Xaa at position 252 is Tyr, Phe, Met, His, Ile, Leu, Val Ala, or Gly
  SITE (262)..(262): Xaa at position 262 is Tyr, Phe, Met, His, Ile, Leu, Val Ala, or Gly
  SITE (264)..(264): Xaa at position 264 is Leu, Ala, Val, Gly, or Ile
  SITE (278)..(278): Xaa at position 278 is Cys, Ala, Val, Gly, Ser, or Thr
  SITE (520)..(520): Xaa at position 520 is Ala, Gly, or Pro
LPMAFAVIGDLKCTTVSINDVDTGAPSISTDTVDVTNGLGTYYVLDRVYLNTTLLLNGYXPTSGSTYRNXALKGTLLXSRLWXKPPFLSDXINGIXXKXKNTKVIKKGVMYSEXPXXTXGSTXVNTSYSXXVQPHTTNLDNKLQGLXEXSXXQYTXXEYPXTXCHPKLGNKRVELWHWDTGVVSCLYKRNFTYDVNADYXYFXXYQEGGTXYXYFTDTGVVTKXLFNVYLGTVLSHYXXXPXTXSSAMTLEXWVTPLTSKQXLXAFNQDGVIFNAVDXKSDFMSEIKCKTLSIAPSTGVYELNGYTVQPIADVYRRIPNLPDCNIEAWLNDKSVPSPLNWERKTFSNCNFNMSSLMSFIQADSFTCNNIDAAKIYGMCFSSITIDKFAIPNGRKVDLQLGNLGYLQSFNYRIDTTATSCQLYYNLPAANVSVSRFNPSTWNRRFGFTEQFVFKPQPVGVFTHHDVVYAQHCFKAPTNFCPCKLDGSLCVGNGPGIDAGYKNSGIGTCPAGTKYLTCHNAXQCDCLCTPDPITSKSTGPYKCPQTKYLVGIGEHCSGLAIKSDYCGGNPCTCQPQAFLGWSVDSCLQGDRCNIFANFILHDVNSGTTCSTDLQKSNTDIILGVCVNYDLYGITGQGIFVEVNATYYNSWQNLLYDSNGNLYGFRDYLTNRTFMIRSCYSGRVSAAFHANSSEPALLFRNIKCNYVFNNTLSRQLQPINYFDSYLGCVVNADNSTSSVVQTCDLTVGSGYCVDYSTKRRSRRAITTGYRFTTFEPFTVNSVNDSLEPVGGLYEIQIPSEFTIGNMEEFIQTSSPKVTIDCSAFVCGDYAACKSQLVEYGSFCDNINAILTEVNELLDTTQLQVANSLMNGVTLSTKLKDGVNFNVDDINFSPVLG

SEQ ID NO: 732 - protein, 2040 aa, Homo sapiens
  SITE (1640)..(1640): Xaa at position 1640 is Trp, Tyr, Phe, Met, His, Ile Leu, Val, Ala, or Gly
  SITE (1665)..(1665): Xaa at position 1665 is Cys, Ala, Val, Gly, Ser, or Thr
  SITE (1676)..(1676): Xaa at position 1676 is Cys, Ala, Val, Gly, Ser, or Thr
MEHKEVVLLLLLFLKSAAPEQSHVVQDCYHGDGQSYRGTYSTTVTGRTCQAWSSMTPHQHNRTTENYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDPVAAPYCYTRDPSVRWEYCNLTQCSDAEGTAVAPPTITPIPSLEAPSEQAPTEQRPGVQECYHGNGQSYQGTYFITVTGRTCQAWSSMTPHSHSRTPAYYPNAGLIKNYCRNPDPVAAPWCYTTDPSVRWEYCNLTRCSDAEWTAFVPPNVILAPSLEAFFEQALTEETPGVQDCYYHYGQSYRGTYSTTVTGRTCQAWSSMTPHQHSRTPENYPNAGLTRNYCRNPDAEIRPWCYTMDPSVRWEYCNLTQCLVTESSVLATLTVVPDPSTEASSEEAPTEQSPGVQDCYHGDGQSYRGSFSTTVTGRTCQSWSSMTPHWHQRTTEYYPNGGLTRNYCRNPDAEISPWCYTMDPNVRWEYCNLTQCPVTESSVLATSTAVSEQAPTEQSPTVQDCYHGDGQSYRGSFSTTVTGRTCQSWSSMTPHWHQRTTEYYPNGGLTRNYCRNPDAEIRPWCYTMDPSVRWEYCNLTQCPVMESTLLTTPTVVPVPSTELPSEEAPTENSTGVQDCYRGDGQSYRGTLSTTITGRTCQSWSSMTPHWHRRIPLYYPNAGLTRNYCRNPDAEIRPWCYTMDPSVRWEYCNLTRCPVTESSVLTTPTVAPVPSTEAPSEQAPPEKSPVVQDCYHGDGRSYRGISSTTVTGRTCQSWSSMIPHWHQRTPENYPNAGLTENYCRNPDSGKQPWCYTTDPCVRWEYCNLTQCSETESGVLETPTVVPVPSMEAHSEAAPTEQTPVVRQCYHGNGQSYRGTFSTTVTGRTCQSXSSMTPHRHQRTPENYPNDGLTMNYXRNPDADTGPWXFTTDPSIRWEYCNLTRCSDTEGTVVAPPTVIQVPSLGPPSEQDCMFGNGKGYRGKKATTVTGTPCQEWAAQEPHRHSTFIPGTNKWAGLEKNYCRNPDGDINGPWCYTMNPRKLFDYCDIPLCASSSFDCGKPQVEPKKCPGSIVGGCVAHPHSWPWQVSLRTRFGKHFCGGTLISPEWVLTAAHCLKKSSRPSSYKVILGAHQEVNLESHVQEIEVSRLFLEPTQADIALLKLSRPAVITDKVMPACLPSPDYMVTARTECYITGWGETQGTFGTGLLKEAQLLVIENEVCNHYKYICAEHLARGTDSCQGDSGGPLVCFEKDKYILQGVTSWGLGCARPNKPGVYARVSRFVTWIEGMMRNN

SEQ ID NO: 733 - protein, 865 aa, Human immunodeficiency virus 1
  SITE (54)..(54): Xaa at position 54 is Ala, Gly, or Pro
  SITE (92)..(92): Xaa at position 92 is Phe, Tyr, Met, His, Ile, Leu, Val Ala, or Gly
  SITE (94)..(94): Xaa at position 94 is Met, Ile, Leu, Val, Ala, or Gly
  SITE (99)..(99): Xaa at position 99 is Met, Ile, Leu, Val, Ala, or Gly
  SITE (103)..(103): Xaa at position 103 is Met, Ile, Leu, Val, Ala, or Gly
  SITE (107)..(107): Xaa at position 107 is Ile, Ala, Val, Leu, or Gly
  SITE (119)..(119): Xaa at position 119 is Val, Ala, Gly, Leu, or Ile
  SITE (126)..(126): Xaa at position 126 is Val, Ala, Gly, Leu, or Ile
  SITE (145)..(145): Xaa at position 145 is Met, Ile, Leu, Val, Ala, or Gly
  SITE (156)..(156): Xaa at position 156 is Leu, Ala, Val, Gly, or Ile
  SITE (220)..(220): Xaa at position 220 is Ala, Gly, or Pro
  SITE (221)..(221): Xaa at position 221 is Ile, Ala, Val, Leu, or Gly
  SITE (235)..(235): Xaa at position 235 is Cys, Ala, Val, Gly, Ser, or Thr
  SITE (266)..(266): Xaa at position 266 is Val, Ala, Gly, Leu, or Ile
  SITE (281)..(281): Xaa at position 281 is Ile, Ala, Val, Leu, or Gly
  SITE (284)..(284): Xaa at position 284 is Leu, Ala, Val, Gly, or Ile
  SITE (288)..(288): Xaa at position 288 is Val, Ala, Gly, Leu, or Ile
  SITE (321)..(321): Xaa at position 321 is Ile, Ala, Val, Leu, or Gly
  SITE (326)..(326): Xaa at position 326 is Cys, Ala, Val, Gly, Ser, or Thr
  SITE (328)..(328): Xaa at position 328 is Ile, Ala, Val, Leu, or Gly
  SITE (337)..(337): Xaa at position 337 is Leu, Ala, Val, Gly, or Ile
  SITE (340)..(340): Xaa at position 340 is Val, Ala, Gly, Leu, or Ile
  SITE (341)..(341): Xaa at position 341 is Val, Ala, Gly, Leu, or Ile
  SITE (353)..(353): Xaa at position 353 is Ile, Ala, Val, Leu, or Gly
  SITE (378)..(378): Xaa at position 378 is Tyr, Phe, Met, His, Ile, Leu, Val Ala, or Gly
  SITE (379)..(379): Xaa at position 379 is Cys, Ala, Val, Gly, Ser, or Thr
  SITE (385)..(385): Xaa at position 385 is Phe, Tyr, Met, His, Ile, Leu, Val Ala, or Gly
  SITE (417)..(417): Xaa at position 417 is Cys, Ala, Val, Gly, Ser, or Thr
  SITE (422)..(422): Xaa at position 422 is Ile, Ala, Val, Leu, or Gly
  SITE (423)..(423): Xaa at position 423 is Ile, Ala, Val, Leu, or Gly
  SITE (429)..(429): Xaa at position 429 is Val, Ala, Gly, Leu, or Ile
  SITE (432)..(432): Xaa at position 432 is Ala, Gly, or Pro
  SITE (433)..(433): Xaa at position 433 is Met, Ile, Leu, Val, Ala, or Gly
  SITE (452)..(452): Xaa at position 452 is Leu, Ala, Val, Gly, or Ile
  SITE (453)..(453): Xaa at position 453 is Leu, Ala, Val, Gly, or Ile
  SITE (469)..(469): Xaa at position 469 is Ile, Ala, Val, Leu, or Gly
  SITE (470)..(470): Xaa at position 470 is Phe, Tyr, Met, His, Ile, Leu, Val Ala, or Gly
  SITE (481)..(481): Xaa at position 481 is Trp, Tyr, Phe, Met, His, Ile, Leu Val, Ala, or Gly
  SITE (485)..(485): Xaa at position 485 is Leu, Ala, Val, Gly, or Ile
  SITE (491)..(491): Xaa at position 491 is Val, Ala, Gly, Leu, or Ile
  SITE (493)..(493): Xaa at position 493 is Ile, Ala, Val, Leu, or Gly
  SITE (507)..(507): Xaa at position 507 is Val, Ala, Gly, Leu, or Ile
  SITE (550)..(550): Xaa at position 550 is Ile, Ala, Val, Leu, or Gly
  SITE (551)..(551): Xaa at position 551 is Val, Ala, Gly, Leu, or Ile
  SITE (557)..(557): Xaa at position 557 is Leu, Ala, Val, Gly, or Ile
  SITE (558)..(558): Xaa at position 558 is Leu, Ala, Val, Gly, or Ile
  SITE (560)..(560): Xaa at position 560 is Ala, Gly, or Pro
  SITE (561)..(561): Xaa at position 561 is Ile, Ala, Val, Leu, or Gly
  SITE (563)..(563): Xaa at position 563 is Ala, Gly, or Pro
  SITE (567)..(567): Xaa at position 567 is Met, Ile, Leu, Val, Ala, or Gly
  SITE (568)..(568): Xaa at position 568 is Leu, Ala, Val, Gly, or Ile
  SITE (572)..(572): Xaa at position 572 is Val, Ala, Gly, Leu, or Ile
  SITE (575)..(575): Xaa at position 575 is Ile, Ala, Val, Leu, or Gly
  SITE (578)..(578): Xaa at position 578 is Leu, Ala, Val, Gly, or Ile
  SITE (582)..(582): Xaa at position 582 is Val, Ala, Gly, Leu, or Ile
  SITE (637)..(637): Xaa at position 637 is Ile, Ala, Val, Leu, or Gly
  SITE (644)..(644): Xaa at position 644 is Ile, Ala, Val, Leu, or Gly
MRVMGIQRNWQQWGIWGILGFWLLMICSGMGNLWVTVYYGVPVWKEAKTTLFCXSDAKGYDTEVHNVWATHACVPTDPNPQEIVLENVTENXNXWKNDXVDQXHQDXISLWDQSLKPCXKLTPLCXTLNCSDATYNNGTNSTDTXKICSFNATTEXRDKKKKEYALFYRLDIVPLKNESESQNFSEYILINCNTSTIAQACPKVSFDPIPIHYCAPAGYXXLKCNNKTFNGTGPXNNVSTVQCTHGIKPVVSTQLLLNGSLAEEEXVIRSENISNNVKTIXVHXNESXNITCIRPGNNTRRSIRIGPGQAFYAMGDIIGNXREAHXNXSEKAWNETXKKXXEKLVKYFPNKTXEFAPPVGGDLEITTHSFNCGGEFFXXNTTKLXNSTHNSTDSTVNSTDSTAETGNSTNTNITLPXRIRQXXNMWQEXGRXXYAPPSKGNITCISNITGLXXTRDGGENKTENNDTEXXRPGGGDMKDNXRSEXYKYKVXEXKPLGVAPTRAKRRXVEREKRAVGIGAVFLGFLGAAGSTMGAASITLTVQARQLLSGXXQQQSNXXRXXEXQQHXXQLTXWGXKQXQTRXLAIERYLKDQQLLGIWGCSGKLICTTNVPWNSSWSNKSYGDIWDNMTWMQWDREXNNYTNTXYRLLEDSQNQQEKNEQDLLALDKWQSLWSWFSISSWLWYIKIFIMVVGGLIGLRIIFAVLSIVNRVRQGYSPLSLQTLPPNPRELDRLGGIEEEGGEQDRGRSVRLVSGFLPLAWDDLRSLCLFCYHRLRDLLLITTRAVELLARSILKGLQRGWEILKYLGSLVQYWGQELKKSAINLLDTTAIAVAEAADRILELLQRIWRGICNVPTRIRQGFEAALQ

SEQ ID NO: 734 - protein, 221 aa, Bos taurus
  SITE (52)..(52): Xaa at position 52 is Ala, Gly, or Pro
  SITE (67)..(67): Xaa at position 67 is Val, Ala, Gly, Leu, or Ile
  SITE (71)..(71): Xaa at position 71 is Val, Ala, Gly, Leu, or Ile
  SITE (101)..(101): Xaa at position 101 is Cys, Ala, Val, Gly, Ser, or Thr
  SITE (110)..(110): Xaa at position 110 is Val, Ala, Gly, Leu, or Ile
  SITE (127)..(127): Xaa at position 127 is Cys, Ala, Val, Gly, Ser, or Thr
  SITE (129)..(129): Xaa at position 129 is Val, Ala, Gly, Leu, or Ile
  SITE (147)..(147): Xaa at position 147 is Ile, Ala, Val, Leu, or Gly
MACSGFQSHGTWWTSRTWPCTALFFLVFIPVFSKGMNVTQPPVVLASSRGVXSFSCEYESSGKADEXRVTXLREAGSQVTEVCAGTYMVEDELTFLDDSTXIGTSRGNKXNLTIQGLRAMDTGLYVXKXELMYPPPYYVGIGNGTQXYVIDPEPCPDSDFLLWILAAVSSGLFFYSFLITAVSLSKMLKKRSPLTTGVYVKMPPTEPECEKQFQPYFIPIN

SEQ ID NO: 735 - protein, 565 aa, Influenza A virus
  strain A/New Zealand:South Canterbury/35/2000 H1N1
  SITE (7)..(7): Xaa at position 7 is Val, Ala, Gly, Leu, or Ile
  SITE (20)..(20): Xaa at position 20 is Ile, Ala, Val, Leu, or Gly
  SITE (21)..(21): Xaa at position 21 is Cys, Ala, Val, Gly, Ser, or Thr
  SITE (22)..(22): Xaa at position 22 is Ile, Ala, Val, Leu, or Gly
  SITE (26)..(26): Xaa at position 26 is Ala, Gly, or Pro
  SITE (33)..(33): Xaa at position 33 is Val, Ala, Gly, Leu, or Ile
  SITE (36)..(36): Xaa at position 36 is Val, Ala, Gly, Leu, or Ile
  SITE (43)..(43): Xaa at position 43 is Val, Ala, Gly, Leu, or Ile
  SITE (49)..(49): Xaa at position 49 is Leu, Ala, Val, Gly, or Ile
  SITE (50)..(50): Xaa at position 50 is Leu, Ala, Val, Gly, or Ile
  SITE (58)..(58): Xaa at position 58 is Leu, Ala, Val, Gly, or Ile
  SITE (59)..(59): Xaa at position 59 is Cys, Ala, Val, Gly, Ser, or Thr
  SITE (61)..(61): Xaa at position 61 is Leu, Ala, Val, Gly, or Ile
  SITE (67)..(67): Xaa at position 67 is Leu, Ala, Val, Gly, or Ile
  SITE (69)..(69): Xaa at position 69 is Leu, Ala, Val, Gly, or Ile
  SITE (72)..(72): Xaa at position 72 is Cys, Ala, Val, Gly, Ser, or Thr
  SITE (74)..(74): Xaa at position 74 is Val, Ala, Gly, Leu, or Ile
  SITE (75)..(75): Xaa at position 75 is Ala, Gly, or Pro
  SITE (77)..(77): Xaa at position 77 is Trp, Tyr, Phe, Met, His, Ile, Leu Val, Ala, or Gly
  SITE (78)..(78): Xaa at position 78 is Ile, Ala, Val, Leu, or Gly
  SITE (79)..(79): Xaa at position 79 is Leu, Ala, Val, Gly, or Ile
  SITE (84)..(84): Xaa at position 84 is Cys, Ala, Val, Gly, Ser, or Thr
  SITE (87)..(87): Xaa at position 87 is Leu, Ala, Val, Gly, or Ile
  SITE (93)..(93): Xaa at position 93 is Trp, Tyr, Phe, Met, His, Ile, Leu Val, Ala, or Gly
  SITE (95)..(95): Xaa at position 95 is Tyr, Phe, Met, His, Ile, Leu, Val Ala, or Gly
  SITE (96)..(96): Xaa at position 96 is Ile, Ala, Val, Leu, or Gly
  SITE (97)..(97): Xaa at position 97 is Val, Ala, Gly, Leu, or Ile
  SITE (108)..(108): Xaa at position 108 is Tyr, Phe, Met, His, Ile, Leu, Val Ala, or Gly
  SITE (118)..(118): Xaa at position 118 is Leu, Ala, Val, Gly, or Ile
  SITE (122)..(122): Xaa at position 122 is Leu, Ala, Val, Gly, or Ile
  SITE (125)..(125): Xaa at position 125 is Val, Ala, Gly, Leu, or Ile
  SITE (128)..(128): Xaa at position 128 is Phe, Tyr, Met, His, Ile, Leu, Val Ala, or Gly
  SITE (134)..(134): Xaa at position 134 is Phe, Tyr, Met, His, Ile, Leu, Val Ala, or Gly
  SITE (150)..(150): Xaa at position 150 is Ala, Gly, or Pro
  SITE (152)..(152): Xaa at position 152 is Cys, Ala, Val, Gly, Ser, or Thr
  SITE (154)..(154): Xaa at position 154 is His, Phe, Tyr, Lys, Arg, Gly, Ser Thr, Ala, Val, Leu, Ile, Asn, Met, or Gln
  SITE (164)..(164): Xaa at position 164 is Leu, Ala, Val, Gly, or Ile
  SITE (165)..(165): Xaa at position 165 is Leu, Ala, Val, Gly, or Ile
  SITE (167)..(167): Xaa at position 167 is Leu, Ala, Val, Gly, or Ile
  SITE (173)..(173): Xaa at position 173 is Leu, Ala, Val, Gly, or Ile
  SITE (177)..(177): Xaa at position 177 is Leu, Ala, Val, Gly, or Ile
  SITE (189)..(189): Xaa at position 189 is Val, Ala, Gly, Leu, or Ile
  SITE (190)..(190): Xaa at position 190 is Leu, Ala, Val, Gly, or Ile
  SITE (191)..(191): Xaa at position 191 is Val, Ala, Gly, Leu, or Ile
  SITE (192)..(192): Xaa at position 192 is Leu, Ala, Val, Gly, or Ile
  SITE (193)..(193): Xaa at position 193 is Trp, Tyr, Phe, Met, His, Ile, Leu Val, Ala, or Gly
  SITE (195)..(195): Xaa at position 195 is Val, Ala, Gly, Leu, or Ile
  SITE (196)..(196): Xaa at position 196 is His, Phe, Tyr, Lys, Arg, Gly, Ser Thr, Ala, Val, Leu, Ile, Asn, Met, or Gln
  SITE (197)..(197): Xaa at position 197 is His, Phe, Tyr, Lys, Arg, Gly, Ser Thr, Ala, Val, Leu, Ile, Asn, Met, or Gln
  SITE (208)..(208): Xaa at position 208 is Tyr, Phe, Met, His, Ile, Leu, Val Ala, or Gly
  SITE (214)..(214): Xaa at position 214 is Tyr, Phe, Met, His, Ile, Leu, Val Ala, or Gly
  SITE (215)..(215): Xaa at position 215 is Val, Ala, Gly, Leu, or Ile
  SITE (217)..(217): Xaa at position 217 is Val, Ala, Gly, Leu, or Ile
  SITE (218)..(218): Xaa at position 218 is Val, Ala, Gly, Leu, or Ile
  SITE (243)..(243): Xaa at position 243 is Ile, Ala, Val, Leu, or Gly
  SITE (245)..(245): Xaa at position 245 is Tyr, Phe, Met, His, Ile, Leu, Val Ala, or Gly
  SITE (246)..(246): Xaa at position 246 is Tyr, Phe, Met, His, Ile, Leu, Val Ala, or Gly
  SITE (249)..(249): Xaa at position 249 is Leu, Ala, Val, Gly, or Ile
  SITE (250)..(250): Xaa at position 250 is Leu, Ala, Val, Gly, or Ile
  SITE (256)..(256): Xaa at position 256 is Ile, Ala, Val, Leu, or Gly
  SITE (258)..(258): Xaa at position 258 is Phe, Tyr, Met, His, Ile, Leu, Val Ala, or Gly
  SITE (260)..(260): Xaa at position 260 is Ala, Gly, or Pro
  SITE (264)..(264): Xaa at position 264 is Leu, Ala, Val, Gly, or Ile
  SITE (265)..(265): Xaa at position 265 is Ile, Ala, Val, Leu, or Gly
  SITE (266)..(266): Xaa at position 266 is Ala, Gly, or Pro
  SITE (269)..(269): Xaa at position 269 is Tyr, Phe, Met, His, Ile, Leu, Val Ala, or Gly
  SITE (270)..(270): Xaa at position 270 is Ala, Gly, or Pro
  SITE (271)..(271): Xaa at position 271 is Phe, Tyr, Met, His, Ile, Leu, Val Ala, or Gly
  SITE (272)..(272): Xaa at position 272 is Ala, Gly, or Pro
  SITE (273)..(273): Xaa at position 273 is Leu, Ala, Val, Gly, or Ile
  SITE (277)..(277): Xaa at position 277 is Phe, Tyr, Met, His, Ile, Leu, Val Ala, or Gly
  SITE (281)..(281): Xaa at position 281 is Ile, Ala, Val, Leu, or Gly
  SITE (282)..(282): Xaa at position 282 is Ile, Ala, Val, Leu, or Gly
  SITE (291)..(291): Xaa at position 291 is Cys, Ala, Val, Gly, Ser, or Thr
  SITE (295)..(295): Xaa at position 295 is Cys, Ala, Val, Gly, Ser, or Thr
  SITE (301)..(301): Xaa at position 301 is Ala, Gly, or Pro
  SITE (302)..(302): Xaa at position 302 is Ile, Ala, Val, Leu, or Gly
  SITE (312)..(312): Xaa at position 312 is His, Phe, Tyr, Lys, Arg, Gly, Ser Thr, Ala, Val, Leu, Ile, Asn, Met, or Gln
  SITE (330)..(330): Xaa at position 330 is Met, Ile, Leu, Val, Ala, or Gly
  SITE (331)..(331): Xaa at position 331 is Val, Ala, Gly, Leu, or Ile
  SITE (348)..(348): Xaa at position 348 is Ala, Gly, or Pro
  SITE (365)..(365): Xaa at position 365 is Tyr, Phe, Met, His, Ile, Leu, Val Ala, or Gly
  SITE (387)..(387): Xaa at position 387 is Ala, Gly, or Pro
  SITE (388)..(388): Xaa at position 388 is Ile, Ala, Val, Leu, or Gly
  SITE (461)..(461): Xaa at position 461 is Leu, Ala, Val, Gly, or Ile
  SITE (469)..(469): Xaa at position 469 is Leu, Ala, Val, Gly, or Ile
  SITE (485)..(485): Xaa at position 485 is His, Phe, Tyr, Lys, Arg, Gly, Ser Thr, Ala, Val, Leu, Ile, Asn, Met, or Gln
  SITE (487)..(487): Xaa at position 487 is Cys, Ala, Val, Gly, Ser, or Thr
  SITE (491)..(491): Xaa at position 491 is Cys, Ala, Val, Gly, Ser, or Thr
MKVKLLXLLCTFTATYADTXXXGYHXNNSTDTXDTXLEKNVTXTHSVNXXEDSHNGKXXLXKGIAPXQXGNXSXXGXXXGNPEXELXISKESXSXXXETPNPENGTCXPGYFADYEEXREQXSSXSSXERFEIXPKESSWPNHTVTGVSXSXSXNGKSSFYRNXXWXTGKNGXYPNXSKSYANNKEKEXXXXXGXXXPPNIGDQRALXHTENAXXSXXSSHYSRRFTPEIAKRPKVRNQEGRXNXXWTXXEPGDTXIXEXNGNXXXPRXXXXXSRGXGSGXXTSNAPMDEXDAKXQTPQGXXNSSLPFQNVXPVTIGECPKYVRSAKLRXXTGLRNIPSIQSRGLFGXIAGFIEGGWTGMVDGWXGYHHQNEQGSGYAADQKSTQNXXNGITNKVNSVIEKMNTQFTAVGKEFNKLERRMENLNKKVDDGFLDIWTYNAELLVLLENERTLDFHDSNVKNXYEKVKSQXKNNAKEIGNGCFEFYXKXNNEXMESVKNGTYDYPKYSEESKLNREKIDGVKLESMGVYQILAIYSTVASSLVLLVSLGAISFWMCSNGSLQCRICI

SEQ ID NO: 736 - protein, 266 aa, Homo sapiens
  SITE (36)..(36): Xaa at position 36 is Phe, Tyr, Met, His, Ile, Leu, Val Ala, or Gly
  SITE (37)..(37): Xaa at position 37 is Leu, Ala, Val, Gly, or Ile
  SITE (46)..(46): Xaa at position 46 is Phe, Tyr, Met, His, Ile, Leu, Val Ala, or Gly
  SITE (47)..(47): Xaa at position 47 is Phe, Tyr, Met, His, Ile, Leu, Val Ala, or Gly
  SITE (53)..(53): Xaa at position 53 is Val, Ala, Gly, Leu, or Ile
  SITE (55)..(55): Xaa at position 55 is Phe, Tyr, Met, His, Ile, Leu, Val Ala, or Gly
  SITE (56)..(56): Xaa at position 56 is Leu, Ala, Val, Gly, or Ile
  SITE (59)..(59): Xaa at position 59 is Tyr, Phe, Met, His, Ile, Leu, Val Ala, or Gly
  SITE (67)..(67): Xaa at position 67 is Val, Ala, Gly, Leu, or Ile
  SITE (69)..(69): Xaa at position 69 is Phe, Tyr, Met, His, Ile, Leu, Val Ala, or Gly
  SITE (76)..(76): Xaa at position 76 is Tyr, Phe, Met, His, Ile, Leu, Val Ala, or Gly
  SITE (90)..(90): Xaa at position 90 is Trp, Tyr, Phe, Met, His, Ile, Leu Val, Ala, or Gly
  SITE (97)..(97): Xaa at position 97 is Leu, Ala, Val, Gly, or Ile
  SITE (103)..(103): Xaa at position 103 is Ala, Gly, or Pro
  SITE (108)..(108): Xaa at position 108 is Cys, Ala, Val, Gly, Ser, or Thr
  SITE (120)..(120): Xaa at position 120 is Val, Ala, Gly, Leu, or Ile
  SITE (128)..(128): Xaa at position 128 is Val, Ala, Gly, Leu, or Ile
  SITE (138)..(138): Xaa at position 138 is Leu, Ala, Val, Gly, or Ile
  SITE (143)..(143): Xaa at position 143 is Leu, Ala, Val, Gly, or Ile
  SITE (144)..(144): Xaa at position 144 is Leu, Ala, Val, Gly, or Ile
  SITE (145)..(145): Xaa at position 145 is Val, Ala, Gly, Leu, or Ile
  SITE (146)..(146): Xaa at position 146 is Cys, Ala, Val, Gly, Ser, or Thr
  SITE (148)..(148): Xaa at position 148 is Val, Ala, Gly, Leu, or Ile
  SITE (151)..(151): Xaa at position 151 is Phe, Tyr, Met, His, Ile, Leu, Val Ala, or Gly
  SITE (160)..(160): Xaa at position 160 is Trp, Tyr, Phe, Met, His, Ile, Leu Val, Ala, or Gly
  SITE (171)..(171): Xaa at position 171 is Met, Ile, Leu, Val, Ala, or Gly
  SITE (190)..(190): Xaa at position 190 is Leu, Ala, Val, Gly, or Ile
  SITE (199)..(199): Xaa at position 199 is Val, Ala, Gly, Leu, or Ile
  SITE (200)..(200): Xaa at position 200 is Tyr, Phe, Met, His, Ile, Leu, Val Ala, or Gly
  SITE (202)..(202): Xaa at position 202 is Cys, Ala, Val, Gly, Ser, or Thr
  SITE (204)..(204): Xaa at position 204 is Val, Ala, Gly, Leu, or Ile
MVCLKLPGGSCMTALTVTLMVLSSPLALAGDTRPRXXWQPKRECHXXNGTERXRXXDRXFYNQEESXRXDSDVGEXRAVTELGRPDAEYXNSQKDFXEDRRAXVDTYXRHNYGVGESFTXQRRVQPKXTVYPSKTQPXQHHNXXXXSXSGXYPGSIEVRXFLNGQEEKAGXVSTGLIQNGDWTFQTLVMXETVPRSGEXXTXQXEHPSVTSPLTVEWRARSESAQSKMLSGVGGFVLGLLFLGAGLFIYFRNQKGHSGLQPTGFLS

SEQ ID NO: 737 - protein, 383 aa, Homo sapiens
  SITE (28)..(28): Xaa at position 28 is Leu, Ala, Val, Gly, or Ile
  SITE (32)..(32): Xaa at position 32 is Leu, Ala, Val, Gly, or Ile
  SITE (34)..(34): Xaa at position 34 is Val, Ala, Gly, Leu, or Ile
  SITE (45)..(45): Xaa at position 45 is Phe, Tyr, Met, His, Ile, Leu, Val Ala, or Gly
  SITE (51)..(51): Xaa at position 51 is Leu, Ala, Val, Gly, or Ile
  SITE (56)..(56): Xaa at position 56 is Phe, Tyr, Met, His, Ile, Leu, Val Ala, or Gly
  SITE (57)..(57): Xaa at position 57 is Leu, Ala, Val, Gly, or Ile
  SITE (59)..(59): Xaa at position 59 is Tyr, Phe, Met, His, Ile, Leu, Val Ala, or Gly
  SITE (66)..(66): Xaa at position 66 is Ala, Gly, or Pro
  SITE (73)..(73): Xaa at position 73 is Ala, Gly, or Pro
  SITE (96)..(96): Xaa at position 96 is Leu, Ala, Val, Gly, or Ile
  SITE (100)..(100): Xaa at position 100 is Leu, Ala, Val, Gly, or Ile
  SITE (113)..(113): Xaa at position 113 is Leu, Ala, Val, Gly, or Ile
  SITE (119)..(119): Xaa at position 119 is Cys, Ala, Val, Gly, Ser, or Thr
  SITE (133)..(133): Xaa at position 133 is Phe, Tyr, Met, His, Ile, Leu, Val Ala, or Gly
  SITE (140)..(140): Xaa at position 140 is Phe, Tyr, Met, His, Ile, Leu, Val Ala, or Gly
  SITE (141)..(141): Xaa at position 141 is Leu, Ala, Val, Gly, or Ile
  SITE (145)..(145): Xaa at position 145 is Leu, Ala, Val, Gly, or Ile
  SITE (158)..(158): Xaa at position 158 is Ala, Gly, or Pro
  SITE (162)..(162): Xaa at position 162 is Ala, Gly, or Pro
  SITE (165)..(165): Xaa at position 165 is Val, Ala, Gly, Leu, or Ile
  SITE (191)..(191): Xaa at position 191 is Leu, Ala, Val, Gly, or Ile
  SITE (194)..(194): Xaa at position 194 is Tyr, Phe, Met, His, Ile, Leu, Val Ala, or Gly
  SITE (223)..(223): Xaa at position 223 is Val, Ala, Gly, Leu, or Ile
  SITE (225)..(225): Xaa at position 225 is Cys, Ala, Val, Gly, Ser, or Thr
  SITE (227)..(227): Xaa at position 227 is Ala, Gly, or Pro
  SITE (230)..(230): Xaa at position 230 is Phe, Tyr, Met, His, Ile, Leu, Val Ala, or Gly
  SITE (239)..(239): Xaa at position 239 is Trp, Tyr, Phe, Met, His, Ile, Leu Val, Ala, or Gly
  SITE (268)..(268): Xaa at position 268 is Val, Ala, Gly, Leu, or Ile
  SITE (272)..(272): Xaa at position 272 is Ile, Ala, Val, Leu, or Gly
  SITE (282)..(282): Xaa at position 282 is Cys, Ala, Val, Gly, Ser, or Thr
MGLGRVLLFLAVAFPFAPPAAAAEPHSXRYNXMXLSQDESVQSGXLAEGHXDGQPXXRXDRQKRRXKPQGQWXEDVLGAKTWDTETEDLTENGQDXRRTXTHIKDQKGGLHSXQEIRVXEIHEDSSTRGSRHXYYDGELXXSQNXETQESTVPQSSRXQTLXMNXTNFWKEDAMKTKTHYRAMQADCLQKXQRXLKSGVAIRRTVPPMVNVTCSEVSEGNITXTXRXSSXYPRNITLTXRQDGVSLSHNTQQWGDVLPDGNGTYQTWXATRXRQGEEQRFTXYMEHSGNHGTHPVPSGKVLVLQSQRTDFPYVSAAMPCFVIIIILCVPCCKKKTSAAEGPELVSLQVLDQHPVGTGDHRDAAQLGFQPLMSATGSTGSTEGA

SEQ ID NO: 738 - protein, 383 aa, Homo sapiens
  SITE (28)..(28): Xaa at position 28 is Leu, Ala, Val, Gly, or Ile
  SITE (34)..(34): Xaa at position 34 is Val, Ala, Gly, Leu, or Ile
  SITE (49)..(49): Xaa at position 49 is Val, Ala, Gly, Leu, or Ile
  SITE (51)..(51): Xaa at position 51 is Leu, Ala, Val, Gly, or Ile
  SITE (56)..(56): Xaa at position 56 is Phe, Tyr, Met, His, Ile, Leu, Val Ala, or Gly
  SITE (59)..(59): Xaa at position 59 is Cys, Ala, Val, Gly, Ser, or Thr
  SITE (64)..(64): Xaa at position 64 is Cys, Ala, Val, Gly, Ser, or Thr
  SITE (73)..(73): Xaa at position 73 is Ala, Gly, or Pro
  SITE (96)..(96): Xaa at position 96 is Leu, Ala, Val, Gly, or Ile
  SITE (100)..(100): Xaa at position 100 is Leu, Ala, Val, Gly, or Ile
  SITE (113)..(113): Xaa at position 113 is Leu, Ala, Val, Gly, or Ile
  SITE (119)..(119): Xaa at position 119 is Cys, Ala, Val, Gly, Ser, or Thr
  SITE (133)..(133): Xaa at position 133 is Phe, Tyr, Met, His, Ile, Leu, Val Ala, or Gly
  SITE (140)..(140): Xaa at position 140 is Phe, Tyr, Met, His, Ile, Leu, Val Ala, or Gly
  SITE (141)..(141): Xaa at position 141 is Leu, Ala, Val, Gly, or Ile
  SITE (162)..(162): Xaa at position 162 is Ala, Gly, or Pro
  SITE (165)..(165): Xaa at position 165 is Val, Ala, Gly, Leu, or Ile
  SITE (191)..(191): Xaa at position 191 is Leu, Ala, Val, Gly, or Ile
  SITE (221)..(221): Xaa at position 221 is Ile, Ala, Val, Leu, or Gly
  SITE (223)..(223): Xaa at position 223 is Val, Ala, Gly, Leu, or Ile
  SITE (225)..(225): Xaa at position 225 is Cys, Ala, Val, Gly, Ser, or Thr
  SITE (227)..(227): Xaa at position 227 is Ala, Gly, or Pro
  SITE (230)..(230): Xaa at position 230 is Phe, Tyr, Met, His, Ile, Leu, Val Ala, or Gly
  SITE (239)..(239): Xaa at position 239 is Trp, Tyr, Phe, Met, His, Ile, Leu Val, Ala, or Gly
  SITE (268)..(268): Xaa at position 268 is Val, Ala, Gly, Leu, or Ile
  SITE (272)..(272): Xaa at position 272 is Ile, Ala, Val, Leu, or Gly
  SITE (282)..(282): Xaa at position 282 is Cys, Ala, Val, Gly, Ser, or Thr
MGLGPVFLLLAGIFPFAPPGAAAEPHSXRYNLTXLSWDGSVQSGFLTEXHXDGQPXLRXDRQKXRAKPQGQWXEDVLGNKTWDRETRDLTGNGKDXRMTXAHIKDQKEGLHSXQEIRVXEIHEDNSTRSSQHXYYDGELXXSQNLETKEWTMPQSSRAQTLXMNXRNFLKEDAMKTKTHYHAMHADCLQEXRRYLKSGVVLRRTVPPMVNVTRSEASEGNXTXTXRXSGXYPWNITLSXRQDGVSLSHDTQQWGDVLPDGNGTYQTWXATRXCQGEEQRFTXYMEHSGNHSTHPVPSGKVLVLQSHWQTFHVSAVAAAAIFVIIIFYVRCCKKKTSAAEGPELVSLQVLDQHPVGTSDHRDATQLGFQPLMSDLGSTGSTEGA

SEQ ID NO: 739 - protein, 1343 aa, Homo sapiens
  SITE (18)..(18): Xaa at position 18 is Val, Ala, Gly, Leu, or Ile
  SITE (19)..(19): Xaa at position 19 is Ala, Gly, or Pro
  SITE (20)..(20): Xaa at position 20 is Leu, Ala, Val, Gly, or Ile
  SITE (47)..(47): Xaa at position 47 is Val, Ala, Gly, Leu, or Ile
  SITE (49)..(49): Xaa at position 49 is Leu, Ala, Val, Gly, or Ile
  SITE (70)..(70): Xaa at position 70 is Val, Ala, Gly, Leu, or Ile
  SITE (71)..(71): Xaa at position 71 is Tyr, Phe, Met, His, Ile, Leu, Val Ala, or Gly
  SITE (75)..(75): Xaa at position 75 is Val, Ala, Gly, Leu, or Ile
  SITE (88)..(88): Xaa at position 88 is Ala, Gly, or Pro
  SITE (90)..(90): Xaa at position 90 is Val, Ala, Gly, Leu, or Ile
  SITE (91)..(91): Xaa at position 91 is Phe, Tyr, Met, His, Ile, Leu, Val Ala, or Gly
  SITE (92)..(92): Xaa at position 92 is Ala, Gly, or Pro
  SITE (104)..(104): Xaa at position 104 is Met, Ile, Leu, Val, Ala, or Gly
  SITE (119)..(119): Xaa at position 119 is Ile, Ala, Val, Leu, or Gly
  SITE (120)..(120): Xaa at position 120 is Val, Ala, Gly, Leu, or Ile
  SITE (123)..(123): Xaa at position 123 is Ala, Gly, or Pro
  SITE (143)..(143): Xaa at position 143 is Val, Ala, Gly, Leu, or Ile
  SITE (145)..(145): Xaa at position 145 is Tyr, Phe, Met, His, Ile, Leu, Val Ala, or Gly
  SITE (146)..(146): Xaa at position 146 is Leu, Ala, Val, Gly, or Ile
  SITE (148)..(148): Xaa at position 148 is Val, Ala, Gly, Leu, or Ile
  SITE (153)..(153): Xaa at position 153 is Phe, Tyr, Met, His, Ile, Leu, Val Ala, or Gly
  SITE (156)..(156): Xaa at position 156 is Leu, Ala, Val, Gly, or Ile
  SITE (192)..(192): Xaa at position 192 is Val, Ala, Gly, Leu, or Ile
  SITE (220)..(220): Xaa at position 220 is Val, Ala, Gly, Leu, or Ile
  SITE (221)..(221): Xaa at position 221 is Phe, Tyr, Met, His, Ile, Leu, Val Ala, or Gly
  SITE (223)..(223): Xaa at position 223 is Val, Ala, Gly, Leu, or Ile
  SITE (225)..(225): Xaa at position 225 is Leu, Ala, Val, Gly, or Ile
  SITE (248)..(248): Xaa at position 248 is Phe, Tyr, Met, His, Ile, Leu, Val Ala, or Gly
  SITE (250)..(250): Xaa at position 250 is Phe, Tyr, Met, His, Ile, Leu, Val Ala, or Gly
  SITE (251)..(251): Xaa at position 251 is Val, Ala, Gly, Leu, or Ile
  SITE (281)..(281): Xaa at position 281 is Ala, Gly, or Pro
  SITE (282)..(282): Xaa at position 282 is Leu, Ala, Val, Gly, or Ile
  SITE (285)..(285): Xaa at position 285 is Val, Ala, Gly, Leu, or Ile
  SITE (286)..(286): Xaa at position 286 is Ile, Ala, Val, Leu, or Gly
  SITE (288)..(288): Xaa at position 288 is Ala, Gly, or Pro
  SITE (306)..(306): Xaa at position 306 is Ile, Ala, Val, Leu, or Gly
  SITE (309)..(309): Xaa at position 309 is Ile, Ala, Val, Leu, or Gly
  SITE (310)..(310): Xaa at position 310 is Leu, Ala, Val, Gly, or Ile
  SITE (314)..(314): Xaa at position 314 is Leu, Ala, Val, Gly, or Ile
  SITE (318)..(318): Xaa at position 318 is Ala, Gly, or Pro
  SITE (322)..(322): Xaa at position 322 is Met, Ile, Leu, Val, Ala, or Gly
  SITE (323)..(323): Xaa at position 323 is Ile, Ala, Val, Leu, or Gly
  SITE (324)..(324): Xaa at position 324 is Ala, Gly, or Pro
  SITE (325)..(325): Xaa at position 325 is Cys, Ala, Val, Gly, Ser, or Thr
  SITE (326)..(326): Xaa at position 326 is Val, Ala, Gly, Leu, or Ile
  SITE (340)..(340): Xaa at position 340 is Leu, Ala, Val, Gly, or Ile
  SITE (343)..(343): Xaa at position 343 is Ala, Gly, or Pro
MGLEAQRLPGAEEAPVRXXXRVRPLLPKELLHGHQSCLQVEPGLGRXTXGRDRHFGFHVVLAEDAGQEAXXQACXQPLLEAFFEGFNXTXXXYGQTGSGKTYTXGEASVASLLEDEQGXXPRXMAEAFKLIDENDLLDCLVHXSXXEXYKEEXRDXLEVGTASRDIQLREDERGNVVLCGVKEVDVEGLDEXLSLLEMGNAARHTGATHLNHLSSRSHTXXTXTXEQRGRAPSRLPRPAPGQLLVSKXHXXDLAGSERVLKTGSTGERLKESIQINSSLLXXGNXXSXLGDPQRRGSHIPYRDSKXTRXXKDSXGGNXKTVXXXXXSPSSSDFDETLNTXNYXSRAQNIRNRATVNWRPEAERPPEETASGARGPPRHRSETRIIHRGRRAPGPATASAAAAMRLGAECARYRACTDAAYSLLRELQAEPGLPGAAARKVRDWLCAVEGERSALSSASGPDSGIESASVEDQAAQGAGGRKEDEGAQQLLTLQNQVARLEEENRDFLAALEDAMEQYKLQSDRLREQQEEMVELRLRLELVRPGWGGPRLLNGLPPGSFVPRPHTAPLGGAHAHVLGMVPPACLPGDEVGSEQRGEQVTNGREAGAELLTEVNRLGSGSSAASEEEEEEEEPPRRTLHLRRNRISNCSQRAGARPGSLPERKGPELCLEELDAAIPGSRAVGGSKARVQARQVPPATASEWRLAQAQQKIRELAINIRMKEELIGELVRTGKAAQALNRQHSQRIRELEQEAEQVRAELSEGQRQLRELEGKELQDAGERSRLQEFRRRVAAAQSQVQVLKEKKQATERLVSLSAQSEKRLQELERNVQLMRQQQGQLQRRLREETEQKRRLEAEMSKRQHRVKELELKHEQQQKILKIKTEEIAAFQRKRRSGSNGSVVSLEQQQKIEEQKKWLDQEMEKVLQQRRALEELGEELHKREAILAKKEALMQEKTGLESKRLRSSQALNEDIVRVSSRLEHLEKELSEKSGQLRQGSAQSQQQIRGEIDSLRQEKDSLLKQRLEIDGKLRQGSLLSPEEERTLFQLDEAIEALDAAIEYKNEAITCRQRVLRASASLLSQCEMNLMAKLSYLSSSETRALLCKYFDKVVTLREEQHQQQIAFSELEMQLEEQQRLVYWLEVALERQRLEMDRQLTLQQKEHEQNMQLLLQQSRDHLGEGLADSRRQYEARIQALEKELGRYMWINQELKQKLGGVNAVGHSRGGEKRSLCSEGRQAPGNEDELHLAPELLWLSPLTEGAPRTREETRDLVHAPLPLTWKRSSLCGEEQGSPEELRQREAAEPLVGRVLPVGEAGLPWNFGPLSKPRRELRRASPGMIDVRKNPL

SEQ ID NO: 740 - protein, 860 aa, Human immunodeficiency virus 1
  SITE (54)..(54): Xaa at position 54 is Ala, Gly, or Pro
  SITE (69)..(69): Xaa at position 69 is Ala, Gly, or Pro
  SITE (94)..(94): Xaa at position 94 is Met, Ile, Leu, Val, Ala, or Gly
  SITE (99)..(99): Xaa at position 99 is Met, Ile, Leu, Val, Ala, or Gly
  SITE (100)..(100): Xaa at position 100 is Val, Ala, Gly, Leu, or Ile
  SITE (103)..(103): Xaa at position 103 is Met, Ile, Leu, Val, Ala, or Gly
  SITE (121)..(121): Xaa at position 121 is Leu, Ala, Val, Gly, or Ile
  SITE (124)..(124): Xaa at position 124 is Leu, Ala, Val, Gly, or Ile
  SITE (128)..(128): Xaa at position 128 is Leu, Ala, Val, Gly, or Ile
  SITE (145)..(145): Xaa at position 145 is Leu, Ala, Val, Gly, or Ile
  SITE (148)..(148): Xaa at position 148 is Cys, Ala, Val, Gly, Ser, or Thr
  SITE (152)..(152): Xaa at position 152 is Met, Ile, Leu, Val, Ala, or Gly
  SITE (167)..(167): Xaa at position 167 is Phe, Tyr, Met, His, Ile, Leu, Val Ala, or Gly
  SITE (192)..(192): Xaa at position 192 is Leu, Ala, Val, Gly, or Ile
  SITE (203)..(203): Xaa at position 203 is Ala, Gly, or Pro
  SITE (217)..(217): Xaa at position 217 is Cys, Ala, Val, Gly, Ser, or Thr
  SITE (218)..(218): Xaa at position 218 is Ala, Gly, or Pro
  SITE (223)..(223): Xaa at position 223 is Ala, Gly, or Pro
  SITE (224)..(224): Xaa at position 224 is Ile, Ala, Val, Leu, or Gly
  SITE (225)..(225): Xaa at position 225 is Leu, Ala, Val, Gly, or Ile
  SITE (238)..(238): Xaa at position 238 is Cys, Ala, Val, Gly, Ser, or Thr
  SITE (241)..(241): Xaa at position 241 is Val, Ala, Gly, Leu, or Ile
  SITE (258)..(258): Xaa at position 258 is Leu, Ala, Val, Gly, or Ile
  SITE (269)..(269): Xaa at position 269 is Val, Ala, Gly, Leu, or Ile
  SITE (287)..(287): Xaa at position 287 is Phe, Tyr, Met, His, Ile, Leu, Val Ala, or Gly
  SITE (291)..(291): Xaa at position 291 is Val, Ala, Gly, Leu, or Ile
  SITE (293)..(293): Xaa at position 293 is Ile, Ala, Val, Leu, or Gly
  SITE (314)..(314): Xaa at position 314 is Phe, Tyr, Met, His, Ile, Leu, Val Ala, or Gly
  SITE (316)..(316): Xaa at position 316 is Ala, Gly, or Pro
  SITE (324)..(324): Xaa at position 324 is Ile, Ala, Val, Leu, or Gly
  SITE (329)..(329): Xaa at position 329 is Cys, Ala, Val, Gly, Ser, or Thr
  SITE (331)..(331): Xaa at position 331 is Val, Ala, Gly, Leu, or Ile
  SITE (340)..(340): Xaa at position 340 is Leu, Ala, Val, Gly, or Ile
  SITE (343)..(343): Xaa at position 343 is Val, Ala, Gly, Leu, or Ile
  SITE (344)..(344): Xaa at position 344 is Val, Ala, Gly, Leu, or Ile
  SITE (347)..(347): Xaa at position 347 is Leu, Ala, Val, Gly, or Ile
  SITE (357)..(357): Xaa at position 357 is Ile, Ala, Val, Leu, or Gly
  SITE (381)..(381): Xaa at position 381 is Phe, Tyr, Met, His, Ile, Leu, Val Ala, or Gly
  SITE (383)..(383): Xaa at position 383 is Cys, Ala, Val, Gly, Ser, or Thr
  SITE (389)..(389): Xaa at position 389 is Phe, Tyr, Met, His, Ile, Leu, Val Ala, or Gly
  SITE (413)..(413): Xaa at position 413 is Leu, Ala, Val, Gly, or Ile
  SITE (415)..(415): Xaa at position 415 is Cys, Ala, Val, Gly, Ser, or Thr
  SITE (420)..(420): Xaa at position 420 is Ile, Ala, Val, Leu, or Gly
  SITE (421)..(421): Xaa at position 421 is Ile, Ala, Val, Leu, or Gly
  SITE (427)..(427): Xaa at position 427 is Ile, Ala, Val, Leu, or Gly
  SITE (430)..(430): Xaa at position 430 is Ala, Gly, or Pro
  SITE (431)..(431): Xaa at position 431 is Met, Ile, Leu, Val, Ala, or Gly
  SITE (432)..(432): Xaa at position 432 is Tyr, Phe, Met, His, Ile, Leu, Val Ala, or Gly
  SITE (433)..(433): Xaa at position 433 is Ala, Gly, or Pro
  SITE (446)..(446): Xaa at position 446 is Ile, Ala, Val, Leu, or Gly
  SITE (449)..(449): Xaa at position 449 is Leu, Ala, Val, Gly, or Ile
  SITE (450)..(450): Xaa at position 450 is Ile, Ala, Val, Leu, or Gly
  SITE (451)..(451): Xaa at position 451 is Leu, Ala, Val, Gly, or Ile
  SITE (465)..(465): Xaa at position 465 is Phe, Tyr, Met, His, Ile, Leu, Val Ala, or Gly
  SITE (476)..(476): Xaa at position 476 is Trp, Tyr, Phe, Met, His, Ile, Leu Val, Ala, or Gly
  SITE (480)..(480): Xaa at position 480 is Leu, Ala, Val, Gly, or Ile
  SITE (486)..(486): Xaa at position 486 is Val, Ala, Gly, Leu, or Ile
  SITE (488)..(488): Xaa at position 488 is Ile, Ala, Val, Leu, or Gly
  SITE (502)..(502): Xaa at position 502 is Val, Ala, Gly, Leu, or Ile
  SITE (545)..(545): Xaa at position 545 is Ile, Ala, Val, Leu, or Gly
  SITE (546)..(546): Xaa at position 546 is Val, Ala, Gly, Leu, or Ile
  SITE (552)..(552): Xaa at position 552 is Leu, Ala, Val, Gly, or Ile
  SITE (553)..(553): Xaa at position 553 is Leu, Ala, Val, Gly, or Ile
  SITE (555)..(555): Xaa at position 555 is Ala, Gly, or Pro
  SITE (556)..(556): Xaa at position 556 is Ile, Ala, Val, Leu, or Gly
  SITE (558)..(558): Xaa at position 558 is Ala, Gly, or Pro
  SITE (562)..(562): Xaa at position 562 is Leu, Ala, Val, Gly, or Ile
  SITE (563)..(563): Xaa at position 563 is Leu, Ala, Val, Gly, or Ile
  SITE (567)..(567): Xaa at position 567 is Val, Ala, Gly, Leu, or Ile
  SITE (570)..(570): Xaa at position 570 is Ile, Ala, Val, Leu, or Gly
  SITE (573)..(573): Xaa at position 573 is Leu, Ala, Val, Gly, or Ile
  SITE (577)..(577): Xaa at position 577 is Val, Ala, Gly, Leu, or Ile
  SITE (632)..(632): Xaa at position 632 is Ile, Ala, Val, Leu, or Gly
  SITE (639)..(639): Xaa at position 639 is Ile, Ala, Val, Leu, or Gly
MRVMGIQRNCQHLFRWGTMILGMIIICSAAENLWVTVYYGVPVWKDAETTLFCXSDAKAYETEKHNVWXTHACVPTDPNPQEIHLENVTEEFNXWKNNXXEQXHTDIISLWDQSLKPCVKXTPXCVTXQCTNVTNNITDDMRGEXKNXSFNXTTELRDKKQKVYSLXYRLDVVQINENQGNRSNNSNKEYRXINCNTSAITQXCPKVSFEPIPIHYXXPAGFXXXKCKDKKFNGTGPXPSXSTVQCTHGIKPVVSTQXLLNGSLAEEEXMIRSENITNNAKNILVQXNTPXQXNCTRPNNNTRKSIRIGPGQAXYXTGDIIGDXRQAHXTXSKATWNETXGKXXKQXRKHFGNNTIXRFANSSGGDLEVTTHSFNCGGEFXYXNTSGLXNSTWISNTSVQGSNSTGSNDSITXPXRIKQXXNMWQRXGQXXXXPPIQGVIRCVSNXTGXXXTRDGGSTNSTTETXRPGGGDMRDNXRSEXYKYKVXKXEPLGVAPTRAKRRXVGREKRAVGIGAVFLGFLGAAGSTMGAASMTLTVQARNLLSGXXQQQSNXXRXXEXQQHXXKLTXWGXKQXQARXLAVERYLRDQQLLGIWGCSGKLICTTNVPWNSSWSNRNLSEIWDNMTWLQWDKEXSNYTQIXYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKISAINLFDTIAIAVAEWTDRVIEIGQRLCRAFLHIPRRIRQGLERALL

SEQ ID NO: 741 - protein, 860 aa, Human immunodeficiency virus 1
  SITE (44)..(44): Xaa at position 44 is Trp, Tyr, Phe, Met, His, Ile, Leu Val, Ala, or Gly
  SITE (52)..(52): Xaa at position 52 is Phe, Tyr, Met, His, Ile, Leu, Val Ala, or Gly
  SITE (53)..(53): Xaa at position 53 is Cys, Ala, Val, Gly, Ser, or Thr
  SITE (54)..(54): Xaa at position 54 is Ala, Gly, or Pro
  SITE (68)..(68): Xaa at position 68 is Trp, Tyr, Phe, Met, His, Ile, Leu Val, Ala, or Gly
  SITE (69)..(69): Xaa at position 69 is Ala, Gly, or Pro
  SITE (92)..(92): Xaa at position 92 is Phe, Tyr, Met, His, Ile, Leu, Val Ala, or Gly
  SITE (94)..(94): Xaa at position 94 is Met, Ile, Leu, Val, Ala, or Gly
  SITE (95)..(95): Xaa at position 95 is Trp, Tyr, Phe, Met, His, Ile, Leu Val, Ala, or Gly
  SITE (99)..(99): Xaa at position 99 is Met, Ile, Leu, Val, Ala, or Gly
  SITE (100)..(100): Xaa at position 100 is Val, Ala, Gly, Leu, or Ile
  SITE (103)..(103): Xaa at position 103 is Met, Ile, Leu, Val, Ala, or Gly
  SITE (110)..(110): Xaa at position 110 is Leu, Ala, Val, Gly, or Ile
  SITE (118)..(118): Xaa at position 118 is Cys, Ala, Val, Gly, Ser, or Thr
  SITE (119)..(119): Xaa at position 119 is Val, Ala, Gly, Leu, or Ile
  SITE (121)..(121): Xaa at position 121 is Leu, Ala, Val, Gly, or Ile
  SITE (124)..(124): Xaa at position 124 is Leu, Ala, Val, Gly, or Ile
  SITE (125)..(125): Xaa at position 125 is Cys, Ala, Val, Gly, Ser, or Thr
  SITE (128)..(128): Xaa at position 128 is Leu, Ala, Val, Gly, or Ile
  SITE (130)..(130): Xaa at position 130 is Cys, Ala, Val, Gly, Ser, or Thr
  SITE (145)..(145): Xaa at position 145 is Leu, Ala, Val, Gly, or Ile
  SITE (148)..(148): Xaa at position 148 is Cys, Ala, Val, Gly, Ser, or Thr
  SITE (150)..(150): Xaa at position 150 is Phe, Tyr, Met, His, Ile, Leu, Val Ala, or Gly
  SITE (152)..(152): Xaa at position 152 is Met, Ile, Leu, Val, Ala, or Gly
  SITE (164)..(164): Xaa at position 164 is Tyr, Phe, Met, His, Ile, Leu, Val Ala, or Gly
  SITE (167)..(167): Xaa at position 167 is Phe, Tyr, Met, His, Ile, Leu, Val Ala, or Gly
  SITE (192)..(192): Xaa at position 192 is Leu, Ala, Val, Gly, or Ile
  SITE (195)..(195): Xaa at position 195 is Cys, Ala, Val, Gly, Ser, or Thr
  SITE (200)..(200): Xaa at position 200 is Ile, Ala, Val, Leu, or Gly
  SITE (203)..(203): Xaa at position 203 is Ala, Gly, or Pro
  SITE (204)..(204): Xaa at position 204 is Cys, Ala, Val, Gly, Ser, or Thr
  SITE (217)..(217): Xaa at position 217 is Cys, Ala, Val, Gly, Ser, or Thr
  SITE (218)..(218): Xaa at position 218 is Ala, Gly, or Pro
  SITE (223)..(223): Xaa at position 223 is Ala, Gly, or Pro
  SITE (224)..(224): Xaa at position 224 is Ile, Ala, Val, Leu, or Gly
  SITE (225)..(225): Xaa at position 225 is Leu, Ala, Val, Gly, or Ile
  SITE (227)..(227): Xaa at position 227 is Cys, Ala, Val, Gly, Ser, or Thr
  SITE (238)..(238): Xaa at position 238 is Cys, Ala, Val, Gly, Ser, or Thr
  SITE (241)..(241): Xaa at position 241 is Val, Ala, Gly, Leu, or Ile
  SITE (250)..(250): Xaa at position 250 is Ile, Ala, Val, Leu, or Gly
  SITE (258)..(258): Xaa at position 258 is Leu, Ala, Val, Gly, or Ile
  SITE (269)..(269): Xaa at position 269 is Val, Ala, Gly, Leu, or Ile
  SITE (285)..(285): Xaa at position 285 is Val, Ala, Gly, Leu, or Ile
  SITE (287)..(287): Xaa at position 287 is Phe, Tyr, Met, His, Ile, Leu, Val Ala, or Gly
  SITE (291)..(291): Xaa at position 291 is Val, Ala, Gly, Leu, or Ile
  SITE (293)..(293): Xaa at position 293 is Ile, Ala, Val, Leu, or Gly
  SITE (295)..(295): Xaa at position 295 is Cys, Ala, Val, Gly, Ser, or Thr
  SITE (314)..(314): Xaa at position 314 is Phe, Tyr, Met, His, Ile, Leu, Val Ala, or Gly
  SITE (316)..(316): Xaa at position 316 is Ala, Gly, or Pro
  SITE (324)..(324): Xaa at position 324 is Ile, Ala, Val, Leu, or Gly
  SITE (329)..(329): Xaa at position 329 is Cys, Ala, Val, Gly, Ser, or Thr
  SITE (331)..(331): Xaa at position 331 is Val, Ala, Gly, Leu, or Ile
  SITE (336)..(336): Xaa at position 336 is Trp, Tyr, Phe, Met, His, Ile, Leu Val, Ala, or Gly
  SITE (340)..(340): Xaa at position 340 is Leu, Ala, Val, Gly, or Ile
  SITE (343)..(343): Xaa at position 343 is Val, Ala, Gly, Leu, or Ile
  SITE (344)..(344): Xaa at position 344 is Val, Ala, Gly, Leu, or Ile
  SITE (347)..(347): Xaa at position 347 is Leu, Ala, Val, Gly, or Ile
  SITE (357)..(357): Xaa at position 357 is Ile, Ala, Val, Leu, or Gly
  SITE (359)..(359): Xaa at position 359 is Phe, Tyr, Met, His, Ile, Leu, Val Ala, or Gly
  SITE (372)..(372): Xaa at position 372 is His, Phe, Tyr, Lys, Arg, Gly, Ser Thr, Ala, Val, Leu, Ile, Asn, Met, or Gln
  SITE (376)..(376): Xaa at position 376 is Cys, Ala, Val, Gly, Ser, or Thr
  SITE (381)..(381): Xaa at position 381 is Phe, Tyr, Met, His, Ile, Leu, Val Ala, or Gly
  SITE (382)..(382): Xaa at position 382 is Tyr, Phe, Met, His, Ile, Leu, Val Ala, or Gly
  SITE (383)..(383): Xaa at position 383 is Cys, Ala, Val, Gly, Ser, or Thr
  SITE (388)..(388): Xaa at position 388 is Leu, Ala, Val, Gly, or Ile
  SITE (389)..(389): Xaa at position 389 is Phe, Tyr, Met, His, Ile, Leu, Val Ala, or Gly
  SITE (413)..(413): Xaa at position 413 is Leu, Ala, Val, Gly, or Ile
  SITE (415)..(415): Xaa at position 415 is Cys, Ala, Val, Gly, Ser, or Thr
  SITE (417)..(417): Xaa at position 417 is Ile, Ala, Val, Leu, or Gly
  SITE (420)..(420): Xaa at position 420 is Ile, Ala, Val, Leu, or Gly
  SITE (421)..(421): Xaa at position 421 is Ile, Ala, Val, Leu, or Gly
  SITE (427)..(427): Xaa at position 427 is Ile, Ala, Val, Leu, or Gly
  SITE (430)..(430): Xaa at position 430 is Ala, Gly, or Pro
  SITE (431)..(431): Xaa at position 431 is Met, Ile, Leu, Val, Ala, or Gly
  SITE (432)..(432): Xaa at position 432 is Tyr, Phe, Met, His, Ile, Leu, Val Ala, or Gly
  SITE (433)..(433): Xaa at position 433 is Ala, Gly, or Pro
  SITE (442)..(442): Xaa at position 442 is Cys, Ala, Val, Gly, Ser, or Thr
  SITE (446)..(446): Xaa at position 446 is Ile, Ala, Val, Leu, or Gly
  SITE (449)..(449): Xaa at position 449 is Leu, Ala, Val, Gly, or Ile
  SITE (451)..(451): Xaa at position 451 is Leu, Ala, Val, Gly, or Ile
  SITE (465)..(465): Xaa at position 465 is Phe, Tyr, Met, His, Ile, Leu, Val Ala, or Gly
  SITE (476)..(476): Xaa at position 476 is Trp, Tyr, Phe, Met, His, Ile, Leu Val, Ala, or Gly
  SITE (480)..(480): Xaa at position 480 is Leu, Ala, Val, Gly, or Ile
  SITE (483)..(483): Xaa at position 483 is Tyr, Phe, Met, His, Ile, Leu, Val Ala, or Gly
  SITE (486)..(486): Xaa at position 486 is Val, Ala, Gly, Leu, or Ile
  SITE (488)..(488): Xaa at position 488 is Ile, Ala, Val, Leu, or Gly
  SITE (494)..(494): Xaa at position 494 is Ala, Gly, or Pro
  SITE (502)..(502): Xaa at position 502 is Val, Ala, Gly, Leu, or Ile
  SITE (545)..(545): Xaa at position 545 is Ile, Ala, Val, Leu, or Gly
  SITE (546)..(546): Xaa at position 546 is Val, Ala, Gly, Leu, or Ile
  SITE (552)..(552): Xaa at position 552 is Leu, Ala, Val, Gly, or Ile
  SITE (553)..(553): Xaa at position 553 is Leu, Ala, Val, Gly, or Ile
  SITE (555)..(555): Xaa at position 555 is Ala, Gly, or Pro
  SITE (556)..(556): Xaa at position 556 is Ile, Ala, Val, Leu, or Gly
  SITE (558)..(558): Xaa at position 558 is Ala, Gly, or Pro
  SITE (562)..(562): Xaa at position 562 is Leu, Ala, Val, Gly, or Ile
  SITE (563)..(563): Xaa at position 563 is Leu, Ala, Val, Gly, or Ile
  SITE (567)..(567): Xaa at position 567 is Val, Ala, Gly, Leu, or Ile
  SITE (570)..(570): Xaa at position 570 is Ile, Ala, Val, Leu, or Gly
  SITE (573)..(573): Xaa at position 573 is Leu, Ala, Val, Gly, or Ile
  SITE (577)..(577): Xaa at position 577 is Val, Ala, Gly, Leu, or Ile
  SITE (632)..(632): Xaa at position 632 is Ile, Ala, Val, Leu, or Gly
  SITE (639)..(639): Xaa at position 639 is Ile, Ala, Val, Leu, or Gly
MRVMGIQRNCQHLFRWGTMILGMIIICSAAENLWVTVYYGVPVXKDAETTLXXXSDAKAYETEKHNVXXTHACVPTDPNPQEIHLENVTEEXNXXKNNXXEQXHTDIISXWDQSLKPXXKXTPXXVTXQXTNVTNNITDDMRGEXKNXSXNXTTELRDKKQKVXSLXYRLDVVQINENQGNRSNNSNKEYRXINXNTSAXTQXXPKVSFEPIPIHYXXPAGFXXXKXKDKKFNGTGPXPSXSTVQCTHGXKPVVSTQXLLNGSLAEEEXMIRSENITNNAKNILXQXNTPXQXNXTRPNNNTRKSIRIGPGQAXYXTGDIIGDXRQAHXTXSKATXNETXGKXXKQXRKHFGNNTIXRXANSSGGDLEVTTXSFNXGGEFXXXNTSGXXNSTWISNTSVQGSNSTGSNDSITXPXRXKQXXNMWQRXGQXXXXPPIQGVIRXVSNXTGXIXTRDGGSTNSTTETXRPGGGDMRDNXRSEXYKXKVXKXEPLGVXPTRAKRRXVGREKRAVGIGAVFLGFLGAAGSTMGAASMTLTVQARNLLSGXXQQQSNXXRXXEXQQHXXKLTXWGXKQXQARXLAVERYLRDQQLLGIWGCSGKLICTTNVPWNSSWSNRNLSEIWDNMTWLQWDKEXSNYTQIXYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKISAINLFDTIAIAVAGWTDRVIEIGQRLCRAFLHIPRRIRQGFERALL

SEQ ID NO: 742 - protein, 266 aa, Homo sapiens
  SITE (36)..(36): Xaa at position 36 is Phe, Tyr, Met, His, Ile, Leu, Val Ala, or Gly
  SITE (37)..(37): Xaa at position 37 is Leu, Ala, Val, Gly, or Ile
  SITE (46)..(46): Xaa at position 46 is Phe, Tyr, Met, His, Ile, Leu, Val Ala, or Gly
  SITE (47)..(47): Xaa at position 47 is Phe, Tyr, Met, His, Ile, Leu, Val Ala, or Gly
  SITE (53)..(53): Xaa at position 53 is Val, Ala, Gly, Leu, or Ile
  SITE (55)..(55): Xaa at position 55 is Phe, Tyr, Met, His, Ile, Leu, Val Ala, or Gly
  SITE (56)..(56): Xaa at position 56 is Leu, Ala, Val, Gly, or Ile
  SITE (67)..(67): Xaa at position 67 is Leu, Ala, Val, Gly, or Ile
  SITE (69)..(69): Xaa at position 69 is Phe, Tyr, Met, His, Ile, Leu, Val Ala, or Gly
  SITE (76)..(76): Xaa at position 76 is Tyr, Phe, Met, His, Ile, Leu, Val Ala, or Gly
  SITE (90)..(90): Xaa at position 90 is Trp, Tyr, Phe, Met, His, Ile, Leu Val, Ala, or Gly
  SITE (97)..(97): Xaa at position 97 is Leu, Ala, Val, Gly, or Ile
  SITE (103)..(103): Xaa at position 103 is Ala, Gly, or Pro
  SITE (108)..(108): Xaa at position 108 is Cys, Ala, Val, Gly, Ser, or Thr
  SITE (120)..(120): Xaa at position 120 is Val, Ala, Gly, Leu, or Ile
  SITE (128)..(128): Xaa at position 128 is Val, Ala, Gly, Leu, or Ile
  SITE (138)..(138): Xaa at position 138 is Leu, Ala, Val, Gly, or Ile
  SITE (143)..(143): Xaa at position 143 is Leu, Ala, Val, Gly, or Ile
  SITE (144)..(144): Xaa at position 144 is Leu, Ala, Val, Gly, or Ile
  SITE (145)..(145): Xaa at position 145 is Val, Ala, Gly, Leu, or Ile
  SITE (146)..(146): Xaa at position 146 is Cys, Ala, Val, Gly, Ser, or Thr
  SITE (148)..(148): Xaa at position 148 is Val, Ala, Gly, Leu, or Ile
  SITE (151)..(151): Xaa at position 151 is Phe, Tyr, Met, His, Ile, Leu, Val Ala, or Gly
  SITE (160)..(160): Xaa at position 160 is Trp, Tyr, Phe, Met, His, Ile, Leu Val, Ala, or Gly
  SITE (171)..(171): Xaa at position 171 is Val, Ala, Gly, Leu, or Ile
  SITE (190)..(190): Xaa at position 190 is Leu, Ala, Val, Gly, or Ile
  SITE (199)..(199): Xaa at position 199 is Val, Ala, Gly, Leu, or Ile
  SITE (200)..(200): Xaa at position 200 is Tyr, Phe, Met, His, Ile, Leu, Val Ala, or Gly
  SITE (202)..(202): Xaa at position 202 is Cys, Ala, Val, Gly, Ser, or Thr
  SITE (204)..(204): Xaa at position 204 is Val, Ala, Gly, Leu, or Ile
MVCLKLPGGSYMAKLTVTLMVLSSPLALAGDTRPRXXQQDKYECHXXNGTERXRXXHRDIYNQEEDXRXDSDVGEXRAVTELGRPDAEYXNSQKDFXEDRRAXVDTYXRHNYGVGESFTXQRRVEPKXTVYPARTQTXQHHNXXXXSXNGXYPGSIEVRXFRNSQEEKAGXVSTGLIQNGDWTFQTLVMXETVPRSGEXXTXQXEHPSVTSPLTVEWRAQSESAQSKMLSGVGGFVLGLLFLGAGLFIYFKNQKGHSGLHPTGLVS

SEQ ID NO: 743 - protein, 348 aa, Homo sapiens
  SITE (30)..(30): Xaa at position 30 is Leu, Ala, Val, Gly, or Ile
  SITE (32)..(32): Xaa at position 32 is Tyr, Phe, Met, His, Ile, Leu, Val Ala, or Gly
  SITE (49)..(49): Xaa at position 49 is Ala, Gly, or Pro
  SITE (53)..(53): Xaa at position 53 is Val, Ala, Gly, Leu, or Ile
  SITE (58)..(58): Xaa at position 58 is Phe, Tyr, Met, His, Ile, Leu, Val Ala, or Gly
  SITE (59)..(59): Xaa at position 59 is Val, Ala, Gly, Leu, or Ile
  SITE (61)..(61): Xaa at position 61 is Tyr, Phe, Met, His, Ile, Leu, Val Ala, or Gly
  SITE (87)..(87): Xaa at position 87 is Leu, Ala, Val, Gly, or Ile
  SITE (91)..(91): Xaa at position 91 is Leu, Ala, Val, Gly, or Ile
  SITE (105)..(105): Xaa at position 105 is Ile, Ala, Val, Leu, or Gly
  SITE (118)..(118): Xaa at position 118 is Leu, Ala, Val, Gly, or Ile
  SITE (122)..(122): Xaa at position 122 is Leu, Ala, Val, Gly, or Ile
  SITE (124)..(124): Xaa at position 124 is Cys, Ala, Val, Gly, Ser, or Thr
  SITE (145)..(145): Xaa at position 145 is His, Phe, Tyr, Lys, Arg, Gly, Ser Thr, Ala, Val, Leu, Ile, Asn, Met, or Gln
  SITE (146)..(146): Xaa at position 146 is Leu, Ala, Val, Gly, or Ile
  SITE (162)..(162): Xaa at position 162 is Ala, Gly, or Pro
  SITE (176)..(176): Xaa at position 176 is Ala, Gly, or Pro
  SITE (183)..(183): Xaa at position 183 is Leu, Ala, Val, Gly, or Ile
  SITE (187)..(187): Xaa at position 187 is Cys, Ala, Val, Gly, Ser, or Thr
  SITE (191)..(191): Xaa at position 191 is Leu, Ala, Val, Gly, or Ile
  SITE (223)..(223): Xaa at position 223 is Leu, Ala, Val, Gly, or Ile
  SITE (225)..(225): Xaa at position 225 is Cys, Ala, Val, Gly, Ser, or Thr
  SITE (227)..(227): Xaa at position 227 is Ala, Gly, or Pro
  SITE (230)..(230): Xaa at position 230 is Tyr, Phe, Met, His, Ile, Leu, Val Ala, or Gly
  SITE (239)..(239): Xaa at position 239 is Trp, Tyr, Phe, Met, His, Ile, Leu Val, Ala, or Gly
  SITE (268)..(268): Xaa at position 268 is Ile, Ala, Val, Leu, or Gly
  SITE (272)..(272): Xaa at position 272 is Val, Ala, Gly, Leu, or Ile
  SITE (282)..(282): Xaa at position 282 is Cys, Ala, Val, Gly, Ser, or Thr
  SITE (284)..(284): Xaa at position 284 is Val, Ala, Gly, Leu, or Ile
MGPRARPALLLLMLLQTAVLQGRLLRSHSXHXLFMGASEQDLGLSLFEXLGYXDDQLXXFXDHESRRVEPRTPWVSSRISSQMWLQXSQSXKGWDHMFTVDFWTXMENHNHSKESHTXQVIXGXEMQEDNSTEGYWKYGYDGQDXXEFCPDTLDWRAAEPRXWPTKLEWERHKIRXRQNRAYXERDXPAQXQQLLELGRGVLDQQVPPLVKVTHHVTSSVTTXRXRXLNXYPQNITMKXLKDKQPMDAKEFEPKDVLPNGDGTYQGWXTLAXPPGEEQRYTXQXEHPGLDQPLIVIWEPSPSGTLVIGVISGIAVFVVILFIGILFIILRKRQGSRGAMGHYVLAERE

SEQ ID NO: 744 - protein, 3419 aa, Zika virus
  strain Mr 766 (ZIKV)
  SITE (291)..(291): Xaa at position 291 is Ile, Ala, Val, Leu, or Gly
  SITE (293)..(293): Xaa at position 293 is Cys, Ala, Val, Gly, Ser, or Thr
  SITE (311)..(311): Xaa at position 311 is Val, Ala, Gly, Leu, or Ile
  SITE (313)..(313): Xaa at position 313 is Val, Ala, Gly, Leu, or Ile
  SITE (314)..(314): Xaa at position 314 is Val, Ala, Gly, Leu, or Ile
  SITE (315)..(315): Xaa at position 315 is Leu, Ala, Val, Gly, or Ile
  SITE (320)..(320): Xaa at position 320 is Cys, Ala, Val, Gly, Ser, or Thr
  SITE (321)..(321): Xaa at position 321 is Val, Ala, Gly, Leu, or Ile
  SITE (323)..(323): Xaa at position 323 is Val, Ala, Gly, Leu, or Ile
  SITE (324)..(324): Xaa at position 324 is Met, Ile, Leu, Val, Ala, or Gly
  SITE (325)..(325): Xaa at position 325 is Ala, Gly, or Pro
  SITE (331)..(331): Xaa at position 331 is Val, Ala, Gly, Leu, or Ile
  SITE (333)..(333): Xaa at position 333 is Ile, Ala, Val, Leu, or Gly
  SITE (335)..(335): Xaa at position 335 is Leu, Ala, Val, Gly, or Ile
  SITE (340)..(340): Xaa at position 340 is Val, Ala, Gly, Leu, or Ile
  SITE (349)..(349): Xaa at position 349 is Tyr, Phe, Met, His, Ile, Leu, Val Ala, or Gly
  SITE (350)..(350): Xaa at position 350 is Cys, Ala, Val, Gly, Ser, or Thr
  SITE (351)..(351): Xaa at position 351 is Tyr, Phe, Met, His, Ile, Leu, Val Ala, or Gly
  SITE (370)..(370): Xaa at position 370 is Ala, Gly, or Pro
  SITE (381)..(381): Xaa at position 381 is Val, Ala, Gly, Leu, or Ile
  SITE (395)..(395): Xaa at position 395 is Cys, Ala, Val, Gly, Ser, or Thr
  SITE (403)..(403): Xaa at position 403 is Leu, Ala, Val, Gly, or Ile
  SITE (404)..(404): Xaa at position 404 is Val, Ala, Gly, Leu, or Ile
  SITE (406)..(406): Xaa at position 406 is Cys, Ala, Val, Gly, Ser, or Thr
  SITE (407)..(407): Xaa at position 407 is Ala, Gly, or Pro
  SITE (409)..(409): Xaa at position 409 is Phe, Tyr, Met, His, Ile, Leu, Val Ala, or Gly
  SITE (415)..(415): Xaa at position 415 is Met, Ile, Leu, Val, Ala, or Gly
  SITE (420)..(420): Xaa at position 420 is Ile, Ala, Val, Leu, or Gly
  SITE (425)..(425): Xaa at position 425 is Leu, Ala, Val, Gly, or Ile
  SITE (427)..(427): Xaa at position 427 is Tyr, Phe, Met, His, Ile, Leu, Val Ala, or Gly
  SITE (429)..(429): Xaa at position 429 is Ile, Ala, Val, Leu, or Gly
  SITE (430)..(430): Xaa at position 430 is Met, Ile, Leu, Val, Ala, or Gly
  SITE (431)..(431): Xaa at position 431 is Leu, Ala, Val, Gly, or Ile
  SITE (433)..(433): Xaa at position 433 is Val, Ala, Gly, Leu, or Ile
  SITE (455)..(455): Xaa at position 455 is Val, Ala, Gly, Leu, or Ile
  SITE (464)..(464): Xaa at position 464 is Ala, Gly, or Pro
  SITE (466)..(466): Xaa at position 466 is Leu, Ala, Val, Gly, or Ile
  SITE (472)..(472): Xaa at position 472 is Leu, Ala, Val, Gly, or Ile
  SITE (474)..(474): Xaa at position 474 is Leu, Ala, Val, Gly, or Ile
  SITE (476)..(476): Xaa at position 476 is Cys, Ala, Val, Gly, Ser, or Thr
  SITE (482)..(482): Xaa at position 482 is Leu, Ala, Val, Gly, or Ile
  SITE (488)..(488): Xaa at position 488 is Tyr, Phe, Met, His, Ile, Leu, Val Ala, or Gly
  SITE (489)..(489): Xaa at position 489 is Tyr, Phe, Met, His, Ile, Leu, Val Ala, or Gly
  SITE (490)..(490): Xaa at position 490 is Leu, Ala, Val, Gly, or Ile
  SITE (492)..(492): Xaa at position 492 is Met, Ile, Leu, Val, Ala, or Gly
  SITE (496)..(496): Xaa at position 496 is His, Phe, Tyr, Lys, Arg, Gly, Ser Thr, Ala, Val, Leu, Ile, Asn, Met, or Gln
  SITE (497)..(497): Xaa at position 497 is Trp, Tyr, Phe, Met, His, Ile, Leu Val, Ala, or Gly
  SITE (499)..(499): Xaa at position 499 is Val, Ala, Gly, Leu, or Ile
  SITE (504)..(504): Xaa at position 504 is Phe, Tyr, Met, His, Ile, Leu, Val Ala, or Gly
  SITE (512)..(512): Xaa at position 512 is His, Phe, Tyr, Lys, Arg, Gly, Ser Thr, Ala, Val, Leu, Ile, Asn, Met, or Gln
  SITE (528)..(528): Xaa at position 528 is Leu, Ala, Val, Gly, or Ile
  SITE (529)..(529): Xaa at position 529 is Val, Ala, Gly, Leu, or Ile
  SITE (541)..(541): Xaa at position 541 is Val, Ala, Gly, Leu, or Ile
  SITE (555)..(555): Xaa at position 555 is Leu, Ala, Val, Gly, or Ile
  SITE (574)..(574): Xaa at position 574 is His, Phe, Tyr, Lys, Arg, Gly, Ser Thr, Ala, Val, Leu, Ile, Asn, Met, or Gln
  SITE (575)..(575): Xaa at position 575 is Leu, Ala, Val, Gly, or Ile
  SITE (577)..(577): Xaa at position 577 is Cys, Ala, Val, Gly, Ser, or Thr
  SITE (579)..(579): Xaa at position 579 is Leu, Ala, Val, Gly, or Ile
  SITE (581)..(581): Xaa at position 581 is Met, Ile, Leu, Val, Ala, or Gly
  SITE (584)..(584): Xaa at position 584 is Leu, Ala, Val, Gly, or Ile
  SITE (594)..(594): Xaa at position 594 is Cys, Ala, Val, Gly, Ser, or Thr
  SITE (598)..(598): Xaa at position 598 is Phe, Tyr, Met, His, Ile, Leu, Val Ala, or Gly
  SITE (612)..(612): Xaa at position 612 is Val, Ala, Gly, Leu, or Ile
  SITE (614)..(614): Xaa at position 614 is Val, Ala, Gly, Leu, or Ile
  SITE (616)..(616): Xaa at position 616 is Val, Ala, Gly, Leu, or Ile
  SITE (618)..(618): Xaa at position 618 is Tyr, Phe, Met, His, Ile, Leu, Val Ala, or Gly
  SITE (625)..(625): Xaa at position 625 is Cys, Ala, Val, Gly, Ser, or Thr
  SITE (627)..(627): Xaa at position 627 is Ile, Ala, Val, Leu, or Gly
  SITE (631)..(631): Xaa at position 631 is Met, Ile, Leu, Val, Ala, or Gly
  SITE (632)..(632): Xaa at position 632 is Ala, Gly, or Pro
  SITE (644)..(644): Xaa at position 644 is Leu, Ala, Val, Gly, or Ile
  SITE (645)..(645): Xaa at position 645 is Ile, Ala, Val, Leu, or Gly
  SITE (651)..(651): Xaa at position 651 is Ile, Ala, Val, Leu, or Gly
  SITE (660)..(660): Xaa at position 660 is Met, Ile, Leu, Val, Ala, or Gly
  SITE (662)..(662): Xaa at position 662 is Leu, Ala, Val, Gly, or Ile
  SITE (664)..(664): Xaa at position 664 is Leu, Ala, Val, Gly, or Ile
  SITE (673)..(673): Xaa at position 673 is Ile, Ala, Val, Leu, or Gly
  SITE (674)..(674): Xaa at position 674 is Val, Ala, Gly, Leu, or Ile
  SITE (675)..(675): Xaa at position 675 is Ile, Ala, Val, Leu, or Gly
  SITE (811)..(811): Xaa at position 811 is Ile, Ala, Val, Leu, or Gly
  SITE (978)..(978): Xaa at position 978 is Val, Ala, Gly, Leu, or Ile
  SITE (1008)..(1008): Xaa at position 1008 is Ile, Ala, Val, Leu, or Gly
  SITE (1536)..(1536): Xaa at position 1536 is Val, Ala, Gly, Leu, or Ile
  SITE (1539)..(1539): Xaa at position 1539 is Met, Ile, Leu, Val, Ala, or Gly
  SITE (1545)..(1545): Xaa at position 1545 is His, Phe, Tyr, Lys, Arg, Gly Ser, Thr, Ala, Val, Leu, Ile, Asn, Met, or Gln
  SITE (1547)..(1547): Xaa at position 1547 is Met, Ile, Leu, Val, Ala, or Gly
  SITE (1570)..(1570): Xaa at position 1570 is Val, Ala, Gly, Leu, or Ile
  SITE (1574)..(1574): Xaa at position 1574 is Leu, Ala, Val, Gly, or Ile
  SITE (1575)..(1575): Xaa at position 1575 is Val, Ala, Gly, Leu, or Ile
  SITE (1577)..(1577): Xaa at position 1577 is Tyr, Phe, Met, His, Ile, Leu Val, Ala, or Gly
  SITE (1581)..(1581): Xaa at position 1581 is Trp, Tyr, Phe, Met, His, Ile Leu, Val, Ala, or Gly
  SITE (1593)..(1593): Xaa at position 1593 is Val, Ala, Gly, Leu, or Ile
  SITE (1595)..(1595): Xaa at position 1595 is Leu, Ala, Val, Gly, or Ile
  SITE (1597)..(1597): Xaa at position 1597 is Ala, Gly, or Pro
  SITE (1598)..(1598): Xaa at position 1598 is Val, Ala, Gly, Leu, or Ile
  SITE (1613)..(1613): Xaa at position 1613 is Ile, Ala, Val, Leu, or Gly
  SITE (1623)..(1623): Xaa at position 1623 is Ala, Gly, or Pro
  SITE (1624)..(1624): Xaa at position 1624 is Val, Ala, Gly, Leu, or Ile
  SITE (1637)..(1637): Xaa at position 1637 is Ile, Ala, Val, Leu, or Gly
  SITE (1645)..(1645): Xaa at position 1645 is Ile, Ala, Val, Leu, or Gly
  SITE (1647)..(1647): Xaa at position 1647 is Leu, Ala, Val, Gly, or Ile
  SITE (1648)..(1648): Xaa at position 1648 is Tyr, Phe, Met, His, Ile, Leu Val, Ala, or Gly
  SITE (1653)..(1653): Xaa at position 1653 is Val, Ala, Gly, Leu, or Ile
  SITE (1660)..(1660): Xaa at position 1660 is Val, Ala, Gly, Leu, or Ile
  SITE (1703)..(1703): Xaa at position 1703 is Leu, Ala, Val, Gly, or Ile
  SITE (1706)..(1706): Xaa at position 1706 is Ile, Ala, Val, Leu, or Gly
  SITE (1707)..(1707): Xaa at position 1707 is Val, Ala, Gly, Leu, or Ile
  SITE (1710)..(1710): Xaa at position 1710 is Ala, Gly, or Pro
  SITE (1718)..(1718): Xaa at position 1718 is Val, Ala, Gly, Leu, or Ile
  SITE (1719)..(1719): Xaa at position 1719 is Ile, Ala, Val, Leu, or Gly
  SITE (1720)..(1720): Xaa at position 1720 is Leu, Ala, Val, Gly, or Ile
  SITE (1721)..(1721): Xaa at position 1721 is Ala, Gly, or Pro
  SITE (1726)..(1726): Xaa at position 1726 is Val, Ala, Gly, Leu, or Ile
  SITE (1727)..(1727): Xaa at position 1727 is Ala, Gly, or Pro
  SITE (1730)..(1730): Xaa at position 1730 is Met, Ile, Leu, Val, Ala, or Gly
  SITE (1734)..(1734): Xaa at position 1734 is Leu, Ala, Val, Gly, or Ile
  SITE (1756)..(1756): Xaa at position 1756 is Val, Ala, Gly, Leu, or Ile
  SITE (1758)..(1758): Xaa at position 1758 is Leu, Ala, Val, Gly, or Ile
  SITE (1759)..(1759): Xaa at position 1759 is Met, Ile, Leu, Val, Ala, or Gly
  SITE (1761)..(1761): Xaa at position 1761 is His, Phe, Tyr, Lys, Arg, Gly Ser, Thr, Ala, Val, Leu, Ile, Asn, Met, or Gln
  SITE (1764)..(1764): Xaa at position 1764 is Phe, Tyr, Met, His, Ile, Leu Val, Ala, or Gly
  SITE (1777)..(1777): Xaa at position 1777 is Tyr, Phe, Met, His, Ile, Leu Val, Ala, or Gly
  SITE (1779)..(1779): Xaa at position 1779 is Leu, Ala, Val, Gly, or Ile
  SITE (1781)..(1781): Xaa at position 1781 is Ile, Ala, Val, Leu, or Gly
  SITE (1782)..(1782): Xaa at position 1782 is Met, Ile, Leu, Val, Ala, or Gly
  SITE (1785)..(1785): Xaa at position 1785 is Ala, Gly, or Pro
  SITE (1793)..(1793): Xaa at position 1793 is Ile, Ala, Val, Leu, or Gly
  SITE (1794)..(1794): Xaa at position 1794 is Ala, Gly, or Pro
  SITE (1795)..(1795): Xaa at position 1795 is Ala, Gly, or Pro
  SITE (1799)..(1799): Xaa at position 1799 is Ile, Ala, Val, Leu, or Gly
  SITE (1808)..(1808): Xaa at position 1808 is Ala, Gly, or Pro
  SITE (1809)..(1809): Xaa at position 1809 is Ala, Gly, or Pro
  SITE (1810)..(1810): Xaa at position 1810 is Ala, Gly, or Pro
  SITE (1811)..(1811): Xaa at position 1811 is Ile, Ala, Val, Leu, or Gly
  SITE (1812)..(1812): Xaa at position 1812 is Phe, Tyr, Met, His, Ile, Leu Val, Ala, or Gly
  SITE (1813)..(1813): Xaa at position 1813 is Met, Ile, Leu, Val, Ala, or Gly
  SITE (1850)..(1850): Xaa at position 1850 is Val, Ala, Gly, Leu, or Ile
  SITE (1858)..(1858): Xaa at position 1858 is Val, Ala, Gly, Leu, or Ile
  SITE (1859)..(1859): Xaa at position 1859 is Trp, Tyr, Phe, Met, His, Ile Leu, Val, Ala, or Gly
  SITE (1860)..(1860): Xaa at position 1860 is Phe, Tyr, Met, His, Ile, Leu Val, Ala, or Gly
  SITE (1861)..(1861): Xaa at position 1861 is Val, Ala, Gly, Leu, or Ile
  SITE (1870)..(1870): Xaa at position 1870 is Ile, Ala, Val, Leu, or Gly
  SITE (1871)..(1871): Xaa at position 1871 is Ala, Gly, or Pro
  SITE (1873)..(1873): Xaa at position 1873 is Cys, Ala, Val, Gly, Ser, or Thr
  SITE (1874)..(1874): Xaa at position 1874 is Leu, Ala, Val, Gly, or Ile
  SITE (1877)..(1877): Xaa at position 1877 is Ala, Gly, or Pro
  SITE (1882)..(1882): Xaa at position 1882 is Ile, Ala, Val, Leu, or Gly
  SITE (1884)..(1884): Xaa at position 1884 is Leu, Ala, Val, Gly, or Ile
  SITE (1889)..(1889): Xaa at position 1889 is Phe, Tyr, Met, His, Ile, Leu Val, Ala, or Gly
  SITE (1901)..(1901): Xaa at position 1901 is Trp, Tyr, Phe, Met, His, Ile Leu, Val, Ala, or Gly
  SITE (1903)..(1903): Xaa at position 1903 is Phe, Tyr, Met, His, Ile, Leu Val, Ala, or Gly
  SITE (1904)..(1904): Xaa at position 1904 is Val, Ala, Gly, Leu, or Ile
  SITE (1905)..(1905): Xaa at position 1905 is Ile, Ala, Val, Leu, or Gly
  SITE (1914)..(1914): Xaa at position 1914 is Ala, Gly, or Pro
  SITE (1921)..(1921): Xaa at position 1921 is Val, Ala, Gly, Leu, or Ile
  SITE (1922)..(1922): Xaa at position 1922 is Ile, Ala, Val, Leu, or Gly
  SITE (1938)..(1938): Xaa at position 1938 is Val, Ala, Gly, Leu, or Ile
  SITE (1946)..(1946): Xaa at position 1946 is Val, Ala, Gly, Leu, or Ile
  SITE (1949)..(1949): Xaa at position 1949 is Ala, Gly, or Pro
  SITE (1951)..(1951): Xaa at position 1951 is Ala, Gly, or Pro
  SITE (1952)..(1952): Xaa at position 1952 is Ala, Gly, or Pro
  SITE (1958)..(1958): Xaa at position 1958 is Ile, Ala, Val, Leu, or Gly
  SITE (1969)..(1969): Xaa at position 1969 is Tyr, Phe, Met, His, Ile, Leu Val, Ala, or Gly
  SITE (1970)..(1970): Xaa at position 1970 is Met, Ile, Leu, Val, Ala, or Gly
  SITE (1976)..(1976): Xaa at position 1976 is Ala, Gly, or Pro
  SITE (1983)..(1983): Xaa at position 1983 is Ala, Gly, or Pro
  SITE (1988)..(1988): Xaa at position 1988 is Ala, Gly, or Pro
  SITE (1991)..(1991): Xaa at position 1991 is Leu, Ala, Val, Gly, or Ile
  SITE (1992)..(1992): Xaa at position 1992 is Leu, Ala, Val, Gly, or Ile
  SITE (1995)..(1995): Xaa at position 1995 is Ile, Ala, Val, Leu, or Gly
  SITE (1997)..(1997): Xaa at position 1997 is Leu, Ala, Val, Gly, or Ile
  SITE (2003)..(2003): Xaa at position 2003 is Ala, Gly, or Pro
  SITE (2005)..(2005): Xaa at position 2005 is Leu, Ala, Val, Gly, or Ile
  SITE (2030)..(2030): Xaa at position 2030 is Phe, Tyr, Met, His, Ile, Leu Val, Ala, or Gly
  SITE (2031)..(2031): Xaa at position 2031 is Val, Ala, Gly, Leu, or Ile
  SITE (2033)..(2033): Xaa at position 2033 is Leu, Ala, Val, Gly, or Ile
  SITE (2039)..(2039): Xaa at position 2039 is Leu, Ala, Val, Gly, or Ile
  SITE (2042)..(2042): Xaa at position 2042 is Trp, Tyr, Phe, Met, His, Ile Leu, Val, Ala, or Gly
  SITE (2043)..(2043): Xaa at position 2043 is Leu, Ala, Val, Gly, or Ile
  SITE (2044)..(2044): Xaa at position 2044 is Ala, Gly, or Pro
  SITE (2047)..(2047): Xaa at position 2047 is Val, Ala, Gly, Leu, or Ile
  SITE (2048)..(2048): Xaa at position 2048 is Ala, Gly, or Pro
  SITE (2059)..(2059): Xaa at position 2059 is Trp, Tyr, Phe, Met, His, Ile Leu, Val, Ala, or Gly
  SITE (2060)..(2060): Xaa at position 2060 is Cys, Ala, Val, Gly, Ser, or Thr
  SITE (2069)..(2069): Xaa at position 2069 is Ile, Ala, Val, Leu, or Gly
  SITE (2078)..(2078): Xaa at position 2078 is Val, Ala, Gly, Leu, or Ile
  SITE (2088)..(2088): Xaa at position 2088 is Leu, Ala, Val, Gly, or Ile
  SITE (2095)..(2095): Xaa at position 2095 is Ala, Gly, or Pro
  SITE (2107)..(2107): Xaa at position 2107 is Phe, Tyr, Met, His, Ile, Leu Val, Ala, or Gly
  SITE (2110)..(2110): Xaa at position 2110 is Phe, Tyr, Met, His, Ile, Leu Val, Ala, or Gly
  SITE (2111)..(2111): Xaa at position 2111 is Ala, Gly, or Pro
  SITE (2528)..(2528): Xaa at position 2528 is Trp, Tyr, Phe, Met, His, Ile Leu, Val, Ala, or Gly
  SITE (2543)..(2543): Xaa at position 2543 is Tyr, Phe, Met, His, Ile, Leu Val, Ala, or Gly
  SITE (2548)..(2548): Xaa at position 2548 is Ile, Ala, Val, Leu, or Gly
  SITE (2551)..(2551): Xaa at position 2551 is Val, Ala, Gly, Leu, or Ile
  SITE (2556)..(2556): Xaa at position 2556 is Ala, Gly, or Pro
  SITE (2559)..(2559): Xaa at position 2559 is Ala, Gly, or Pro
  SITE (2560)..(2560): Xaa at position 2560 is Leu, Ala, Val, Gly, or Ile
  SITE (2570)..(2570): Xaa at position 2570 is Ala, Gly, or Pro
  SITE (2571)..(2571): Xaa at position 2571 is Val, Ala, Gly, Leu, or Ile
  SITE (2576)..(2576): Xaa at position 2576 is Ala, Gly, or Pro
  SITE (2578)..(2578): Xaa at position 2578 is Ile, Ala, Val, Leu, or Gly
  SITE (2581)..(2581): Xaa at position 2581 is Leu, Ala, Val, Gly, or Ile
  SITE (2587)..(2587): Xaa at position 2587 is Leu, Ala, Val, Gly, or Ile
  SITE (2593)..(2593): Xaa at position 2593 is Val, Ala, Gly, Leu, or Ile
  SITE (2594)..(2594): Xaa at position 2594 is Val, Ala, Gly, Leu, or Ile
  SITE (2596)..(2596): Xaa at position 2596 is Leu, Ala, Val, Gly, or Ile
  SITE (2598)..(2598): Xaa at position 2598 is Cys, Ala, Val, Gly, Ser, or Thr
  SITE (2607)..(2607): Xaa at position 2607 is Ala, Gly, or Pro
  SITE (2608)..(2608): Xaa at position 2608 is Ala, Gly, or Pro
  SITE (2613)..(2613): Xaa at position 2613 is Val, Ala, Gly, Leu, or Ile
  SITE (2616)..(2616): Xaa at position 2616 is Val, Ala, Gly, Leu, or Ile
  SITE (2619)..(2619): Xaa at position 2619 is Tyr, Phe, Met, His, Ile, Leu Val, Ala, or Gly
  SITE (2648)..(2648): Xaa at position 2648 is Val, Ala, Gly, Leu, or Ile
  SITE (2656)..(2656): Xaa at position 2656 is Cys, Ala, Val, Gly, Ser, or Thr
  SITE (2659)..(2659): Xaa at position 2659 is Leu, Ala, Val, Gly, or Ile
  SITE (2660)..(2660): Xaa at position 2660 is Leu, Ala, Val, Gly, or Ile
  SITE (2661)..(2661): Xaa at position 2661 is Cys, Ala, Val, Gly, Ser, or Thr
  SITE (2672)..(2672): Xaa at position 2672 is Val, Ala, Gly, Leu, or Ile
  SITE (2678)..(2678): Xaa at position 2678 is Leu, Ala, Val, Gly, or Ile
  SITE (2680)..(2680): Xaa at position 2680 is Val, Ala, Gly, Leu, or Ile
  SITE (2681)..(2681): Xaa at position 2681 is Leu, Ala, Val, Gly, or Ile
  SITE (2684)..(2684): Xaa at position 2684 is Val, Ala, Gly, Leu, or Ile
  SITE (2687)..(2687): Xaa at position 2687 is Trp, Tyr, Phe, Met, His, Ile Leu, Val, Ala, or Gly
  SITE (2688)..(2688): Xaa at position 2688 is Leu, Ala, Val, Gly, or Ile
  SITE (2695)..(2695): Xaa at position 2695 is Phe, Tyr, Met, His, Ile, Leu Val, Ala, or Gly
  SITE (2696)..(2696): Xaa at position 2696 is Cys, Ala, Val, Gly, Ser, or Thr
  SITE (2697)..(2697): Xaa at position 2697 is Ile, Ala, Val, Leu, or Gly
  SITE (2699)..(2699): Xaa at position 2699 is Val, Ala, Gly, Leu, or Ile
  SITE (2700)..(2700): Xaa at position 2700 is Leu, Ala, Val, Gly, or Ile
  SITE (2701)..(2701): Xaa at position 2701 is Cys, Ala, Val, Gly, Ser, or Thr
  SITE (2703)..(2703): Xaa at position 2703 is Tyr, Phe, Met, His, Ile, Leu Val, Ala, or Gly
  SITE (2707)..(2707): Xaa at position 2707 is Met, Ile, Leu, Val, Ala, or Gly
  SITE (2711)..(2711): Xaa at position 2711 is Met, Ile, Leu, Val, Ala, or Gly
  SITE (2714)..(2714): Xaa at position 2714 is Leu, Ala, Val, Gly, or Ile
  SITE (2722)..(2722): Xaa at position 2722 is Leu, Ala, Val, Gly, or Ile
  SITE (2725)..(2725): Xaa at position 2725 is Val, Ala, Gly, Leu, or Ile
  SITE (2733)..(2733): Xaa at position 2733 is His, Phe, Tyr, Lys, Arg, Gly Ser, Thr, Ala, Val, Leu, Ile, Asn, Met, or Gln
  SITE (2735)..(2735): Xaa at position 2735 is Met, Ile, Leu, Val, Ala, or Gly
  SITE (2736)..(2736): Xaa at position 2736 is Tyr, Phe, Met, His, Ile, Leu Val, Ala, or Gly
  SITE (2737)..(2737): Xaa at position 2737 is Trp, Tyr, Phe, Met, His, Ile Leu, Val, Ala, or Gly
  SITE (2738)..(2738): Xaa at position 2738 is Val, Ala, Gly, Leu, or Ile
  SITE (2745)..(2745): Xaa at position 2745 is Ile, Ala, Val, Leu, or Gly
  SITE (2749)..(2749): Xaa at position 2749 is Val, Ala, Gly, Leu, or Ile
  SITE (2755)..(2755): Xaa at position 2755 is Leu, Ala, Val, Gly, or Ile
  SITE (2756)..(2756): Xaa at position 2756 is Leu, Ala, Val, Gly, or Ile
  SITE (2794)..(2794): Xaa at position 2794 is Ile, Ala, Val, Leu, or Gly
  SITE (2801)..(2801): Xaa at position 2801 is Ile, Ala, Val, Leu, or Gly
  SITE (2842)..(2842): Xaa at position 2842 is Val, Ala, Gly, Leu, or Ile
  SITE (2845)..(2845): Xaa at position 2845 is Leu, Ala, Val, Gly, or Ile
  SITE (2849)..(2849): Xaa at position 2849 is Trp, Tyr, Phe, Met, His, Ile Leu, Val, Ala, or Gly
  SITE (2880)..(2880): Xaa at position 2880 is Val, Ala, Gly, Leu, or Ile
  SITE (2890)..(2890): Xaa at position 2890 is Val, Ala, Gly, Leu, or Ile
  SITE (2891)..(2891): Xaa at position 2891 is Met, Ile, Leu, Val, Ala, or Gly
  SITE (2898)..(2898): Xaa at position 2898 is Leu, Ala, Val, Gly, or Ile
  SITE (2929)..(2929): Xaa at position 2929 is Ile, Ala, Val, Leu, or Gly
  SITE (2939)..(2939): Xaa at position 2939 is Ala, Gly, or Pro
  SITE (2942)..(2942): Xaa at position 2942 is Ala, Gly, or Pro
  SITE (2948)..(2948): Xaa at position 2948 is Phe, Tyr, Met, His, Ile, Leu Val, Ala, or Gly
  SITE (2964)..(2964): Xaa at position 2964 is Cys, Ala, Val, Gly, Ser, or Thr
  SITE (2967)..(2967): Xaa at position 2967 is Cys, Ala, Val, Gly, Ser, or Thr
  SITE (2968)..(2968): Xaa at position 2968 is Val, Ala, Gly, Leu, or Ile
  SITE (2969)..(2969): Xaa at position 2969 is Tyr, Phe, Met, His, Ile, Leu Val, Ala, or Gly
  SITE (2994)..(2994): Xaa at position 2994 is Met, Ile, Leu, Val, Ala, or Gly
  SITE (2996)..(2996): Xaa at position 2996 is Leu, Ala, Val, Gly, or Ile
  SITE (2998)..(2998): Xaa at position 2998 is Ala, Gly, or Pro
  SITE (3001)..(3001): Xaa at position 3001 is Leu, Ala, Val, Gly, or Ile
  SITE (3005)..(3005): Xaa at position 3005 is Ala, Gly, or Pro
  SITE (3008)..(3008): Xaa at position 3008 is Phe, Tyr, Met, His, Ile, Leu Val, Ala, or Gly
  SITE (3009)..(3009): Xaa at position 3009 is Leu, Ala, Val, Gly, or Ile
  SITE (3014)..(3014): Xaa at position 3014 is Trp, Tyr, Phe, Met, His, Ile Leu, Val, Ala, or Gly
  SITE (3015)..(3015): Xaa at position 3015 is Met, Ile, Leu, Val, Ala, or Gly
  SITE (3024)..(3024): Xaa at position 3024 is Val, Ala, Gly, Leu, or Ile
  SITE (3032)..(3032): Xaa at position 3032 is Leu, Ala, Val, Gly, or Ile
  SITE (3034)..(3034): Xaa at position 3034 is Tyr, Phe, Met, His, Ile, Leu Val, Ala, or Gly
  SITE (3036)..(3036): Xaa at position 3036 is Leu, Ala, Val, Gly, or Ile
  SITE (3039)..(3039): Xaa at position 3039 is Met, Ile, Leu, Val, Ala, or Gly
  SITE (3042)..(3042): Xaa at position 3042 is Ala, Gly, or Pro
  SITE (3047)..(3047): Xaa at position 3047 is Met, Ile, Leu, Val, Ala, or Gly
  SITE (3059)..(3059): Xaa at position 3059 is Ile, Ala, Val, Leu, or Gly
  SITE (3082)..(3082): Xaa at position 3082 is Ala, Gly, or Pro
  SITE (3085)..(3085): Xaa at position 3085 is Val, Ala, Gly, Leu, or Ile
  SITE (3090)..(3090): Xaa at position 3090 is Tyr, Phe, Met, His, Ile, Leu Val, Ala, or Gly
  SITE (3094)..(3094): Xaa at position 3094 is Val, Ala, Gly, Leu, or Ile
  SITE (3095)..(3095): Xaa at position 3095 is Val, Ala, Gly, Leu, or Ile
  SITE (3097)..(3097): Xaa at position 3097 is Val, Ala, Gly, Leu, or Ile
  SITE (3107)..(3107): Xaa at position 3107 is Val, Ala, Gly, Leu, or Ile
  SITE (3110)..(3110): Xaa at position 3110 is Ile, Ala, Val, Leu, or Gly
  SITE (3111)..(3111): Xaa at position 3111 is Ile, Ala, Val, Leu, or Gly
  SITE (3123)..(3123): Xaa at position 3123 is Val, Ala, Gly, Leu, or Ile
  SITE (3126)..(3126): Xaa at position 3126 is Ala, Gly, or Pro
  SITE (3127)..(3127): Xaa at position 3127 is Leu, Ala, Val, Gly, or Ile
  SITE (3130)..(3130): Xaa at position 3130 is Phe, Tyr, Met, His, Ile, Leu Val, Ala, or Gly
  SITE (3133)..(3133): Xaa at position 3133 is Leu, Ala, Val, Gly, or Ile
  SITE (3134)..(3134): Xaa at position 3134 is Val, Ala, Gly, Leu, or Ile
  SITE (3135)..(3135): Xaa at position 3135 is Val, Ala, Gly, Leu, or Ile
  SITE (3137)..(3137): Xaa at position 3137 is Leu, Ala, Val, Gly, or Ile
  SITE (3138)..(3138): Xaa at position 3138 is Ile, Ala, Val, Leu, or Gly
  SITE (3141)..(3141): Xaa at position 3141 is Met, Ile, Leu, Val, Ala, or Gly
  SITE (3149)..(3149): Xaa at position 3149 is Met, Ile, Leu, Val, Ala, or Gly
  SITE (3152)..(3152): Xaa at position 3152 is Leu, Ala, Val, Gly, or Ile
  SITE (3161)..(3161): Xaa at position 3161 is Val, Ala, Gly, Leu, or Ile
  SITE (3165)..(3165): Xaa at position 3165 is Leu, Ala, Val, Gly, or Ile
  SITE (3173)..(3173): Xaa at position 3173 is Leu, Ala, Val, Gly, or Ile
  SITE (3176)..(3176): Xaa at position 3176 is Met, Ile, Leu, Val, Ala, or Gly
  SITE (3177)..(3177): Xaa at position 3177 is Ala, Gly, or Pro
  SITE (3178)..(3178): Xaa at position 3178 is Val, Ala, Gly, Leu, or Ile
  SITE (3184)..(3184): Xaa at position 3184 is Val, Ala, Gly, Leu, or Ile
  SITE (3185)..(3185): Xaa at position 3185 is Val, Ala, Gly, Leu, or Ile
  SITE (3192)..(3192): Xaa at position 3192 is Phe, Tyr, Met, His, Ile, Leu Val, Ala, or Gly
  SITE (3195)..(3195): Xaa at position 3195 is Ala, Gly, or Pro
  SITE (3196)..(3196): Xaa at position 3196 is Leu, Ala, Val, Gly, or Ile
  SITE (3198)..(3198): Xaa at position 3198 is Phe, Tyr, Met, His, Ile, Leu Val, Ala, or Gly
  SITE (3199)..(3199): Xaa at position 3199 is Leu, Ala, Val, Gly, or Ile
  SITE (3202)..(3202): Xaa at position 3202 is Met, Ile, Leu, Val, Ala, or Gly
  SITE (3224)..(3224): Xaa at position 3224 is Val, Ala, Gly, Leu, or Ile
  SITE (3226)..(3226): Xaa at position 3226 is Phe, Tyr, Met, His, Ile, Leu Val, Ala, or Gly
  SITE (3231)..(3231): Xaa at position 3231 is Phe, Tyr, Met, His, Ile, Leu Val, Ala, or Gly
  SITE (3242)..(3242): Xaa at position 3242 is Ile, Ala, Val, Leu, or Gly
  SITE (3243)..(3243): Xaa at position 3243 is Val, Ala, Gly, Leu, or Ile
  SITE (3244)..(3244): Xaa at position 3244 is Val, Ala, Gly, Leu, or Ile
  SITE (3246)..(3246): Xaa at position 3246 is Cys, Ala, Val, Gly, Ser, or Thr
  SITE (3253)..(3253): Xaa at position 3253 is Ile, Ala, Val, Leu, or Gly
  SITE (3256)..(3256): Xaa at position 3256 is Ala, Gly, or Pro
  SITE (3262)..(3262): Xaa at position 3262 is Ala, Gly, or Pro
  SITE (3270)..(3270): Xaa at position 3270 is Ala, Gly, or Pro
  SITE (3273)..(3273): Xaa at position 3273 is Ala, Gly, or Pro
  SITE (3277)..(3277): Xaa at position 3277 is Ala, Gly, or Pro
  SITE (3280)..(3280): Xaa at position 3280 is Trp, Tyr, Phe, Met, His, Ile Leu, Val, Ala, or Gly
  SITE (3282)..(3282): Xaa at position 3282 is Leu, Ala, Val, Gly, or Ile
  SITE (3285)..(3285): Xaa at position 3285 is Phe, Tyr, Met, His, Ile, Leu Val, Ala, or Gly
  SITE (3286)..(3286): Xaa at position 3286 is His, Phe, Tyr, Lys, Arg, Gly Ser, Thr, Ala, Val, Leu, Ile, Asn, Met, or Gln
  SITE (3290)..(3290): Xaa at position 3290 is Leu, Ala, Val, Gly, or Ile
  SITE (3293)..(3293): Xaa at position 3293 is Met, Ile, Leu, Val, Ala, or Gly
  SITE (3294)..(3294): Xaa at position 3294 is Ala, Gly, or Pro
  SITE (3296)..(3296): Xaa at position 3296 is Ala, Gly, or Pro
  SITE (3297)..(3297): Xaa at position 3297 is Ile, Ala, Val, Leu, or Gly
  SITE (3300)..(3300): Xaa at position 3300 is Ala, Gly, or Pro
  SITE (3301)..(3301): Xaa at position 3301 is Val, Ala, Gly, Leu, or Ile
  SITE (3303)..(3303): Xaa at position 3303 is Val, Ala, Gly, Leu, or Ile
  SITE (3316)..(3316): Xaa at position 3316 is His, Phe, Tyr, Lys, Arg, Gly Ser, Thr, Ala, Val, Leu, Ile, Asn, Met, or Gln
  SITE (3328)..(3328): Xaa at position 3328 is Leu, Ala, Val, Gly, or Ile
  SITE (3331)..(3331): Xaa at position 3331 is Trp, Tyr, Phe, Met, His, Ile Leu, Val, Ala, or Gly
  SITE (3334)..(3334): Xaa at position 3334 is Val, Ala, Gly, Leu, or Ile
  SITE (3335)..(3335): Xaa at position 3335 is Trp, Tyr, Phe, Met, His, Ile Leu, Val, Ala, or Gly
  SITE (3341)..(3341): Xaa at position 3341 is His, Phe, Tyr, Lys, Arg, Gly Ser, Thr, Ala, Val, Leu, Ile, Asn, Met, or Gln
  SITE (3354)..(3354): Xaa at position 3354 is Ile, Ala, Val, Leu, or Gly
  SITE (3357)..(3357): Xaa at position 3357 is Leu, Ala, Val, Gly, or Ile
  SITE (3378)..(3378): Xaa at position 3378 is Ala, Gly, or Pro
  SITE (3381)..(3381): Xaa at position 3381 is Ile, Ala, Val, Leu, or Gly
  SITE (3385)..(3385): Xaa at position 3385 is Val, Ala, Gly, Leu, or Ile
  SITE (3391)..(3391): Xaa at position 3391 is Ile, Ala, Val, Leu, or Gly
  SITE (3399)..(3399): Xaa at position 3399 is Met, Ile, Leu, Val, Ala, or Gly
  SITE (3402)..(3402): Xaa at position 3402 is Leu, Ala, Val, Gly, or Ile
MKNPKEEIRRIRIVNMLKRGVARVNPLGGLKRLPAGLLLGHGPIRMVLAILAFLRFTAIKPSLGLINRWGSVGKKEAMEIIKKFKKDLAAMLRIINARKERKRRGADTSIGIIGLLLTTAMAAEITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSXRXIGVSNRDFVEGMSGGTWXDXXXEHGGXXTXXXQDKPTXDXEXVTTTXSNMAEVRSXXXEASISDMASDSRCPTQGEXYLDKQSDTQYXCKRTLVDRGWGNGXGLFGKGSXXTXXKXTCSKKXTGKSXQPENXEXRXXXSXHGSQHSGMIGYETDEDRAKVEXTPNSPRAEXTXGGFGSXGXDXEPRTGXDFSDLXXXTXNNKXXLXHKEWXHDIPLPWXAGADTGTPHWNNKEAXXEFKDAHAKRQTXVVLGSQEGAVHTAXAGALEAEMDGAKGRLFSGXXKXRXKXDKXRLKGVSYSLXTAAXTFTKVPAETLHGTXTXEXQXAGTDGPXKXPVQXXVDMQTLTPVGRXXTANPVXTESTENSKXMXEXDPPFGDSYXXXGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSADVGCSVDFSKKETRCGTGVFXYNDVEAWRDRYKYHPDSPRRLAAAVKQAWEEGICGISSVSRMENIMWKSVEGELNAILEENGVQLTVVVGSVKNPMWRGPQRLPVPVNELPHGWKAWGKSYFVRAAKTNNSFVVDGDTLKECPLEHRAWNSFLVEDHGFGVFHTSVWLKVREDYSLECDPAVIGTAXKGREAAHSDLGYWIESEKNDTWRLKRAHLXEMKTCEWPKSHTLWTDGVEESDLIIPKSLAGPLSHHNTREGYRTQVKGPWHSEELEIRFEECPGTKVYVEETCGTRGPSLRSTTASGRVIEEWCCRECTMPPLSFRAKDGCWYGMEIRPRKEPESNLVRSMVTAGSTDHMDHFSLGVLVILLMVQEGLKKRMTTKIIMSTSMAVLVVMILGGFSMSDLAKLVILMGATFAEMNTGGDVAHLALVAAFKVRPALLVSFIFRANWTPRESMLLALASCLLQTAISALEGDLMVLINGFALAWLAIRAMAVPRTDNIALPILAALTPLARGTLLVAWRAGLATCGGIMLLSLKGKGSVKKNLPFVMALGLTAVRVVDPINVVGLLLLTRSGKRSWPPSEVLTAVGLICALAGGFAKADIEMAGPMAAVGLLIVSYVVSGKSVDMYIERAGDITWEKDAEVTGNSPRLDVALDESGDFSLVEEDGPPMREIILKVVLMAICGMNPIAIPFAAGAWYVYVKTGKRSGALWDVPAPKEVKKGETTDGVYRVMTRRLLGSTQVGXGVXQEGVFXTXWHVTKGAALRSGEGRLDPYWGDXKQDXXSXCGPXKLDAAWDGLSEXQXLXXPPGERARNIQTLPGXFKTKDGDIGXXALDYPAGTSGSPXLDKCGRVXGXXGNGVXIKNGSYXSAITQGKREEETPVECFEPSMLKKKQLTVLDLHPGAGKTRRVXPEXXREXIKKRLRTXXXXPTRVXXAEXEEAXRGLPVRYMTTAVNVTHSGTEIXDXXCXATXTSRLLQPIRVPNXNXNXXDEXHFTDPSSXXXRGYXSTRVEMGEXXXXXXTATPPGTRDAFPDSNSPIMDTEVEVPERAWSSGFDWXTDHSGKTXXXXPSVRNGNEXXAXXTKXGKRVXQXSRKTXETEFQKTKNQEXDXXXTTDISEMGXNFKADRXXDSRRCLKPVILDGERXILAGPMPXTHXSXXQRRGRXGRNPNKPGDEXXYGGGCXETDEGHXHWLEXRMXXDNXYXQDGLIXSXYRPEADKVAAIEGEFKLRTEQRKTXXEXMKRGDXPVXXXYQXXSAGITYTDRRXXFDGTTNNTXMEDSVPAEXWTKYGEKRVXKPRWMDXRVCSDHAALKSXKEXXAGKRGAALGVMEALGTLPGHMTERFQEAIDNLAVLMRAETGSRPYKAAAAQLPETLETIMLLGLLGTVSLGIFFVLMRNKGIGKMGFGMVTLGASAWLMWLSEIEPARIACVLIVVFLLLVVLIPEPEKQRSPQDNQMAIIIMVAVGLLGLITANELGWLERTKNDIAHLMGRREEGATMGFSMDIDLRPASAWAIYAALTTLITPAVQHAVTTSYNNYSLMAMATQAGVLFGMGKGMPFMHGDLGVPLLMMGCYSQLTPLTLIVAIILLVAHYMYLIPGLQAAAARAAQKRTAAGIMKNPVVDGIVVTDIDTMTIDPQVEKKMGQVLLIAVAISSAVLLRTAWGWGEAGALITAATSTLWEGSPNKYWNSSTATSLCNIFRGSYLAGASLIYTVTRNAGLVKRRGGGTGETLGEKXKARLNQMSALEFYSXKKSGXTEXCREEXRRXXKDGVATGGHXXSRGSXKXRWXEERGYXQPYGKXXDXGXGRGGWSYYXXTIRKXQEXRGXTKGGPGHEEPMLVQSYGWNIVRLKSGVDXFHMAAEPXDTXXXDIGESSSSPEXEETRTXRXXSMXGDXXEKRPGAXXXKXXXPXTSTXMETXERXQRRHGGGXVRXPLCRNSTXEXXXXSGAKSNXIKSXSTTSQXXLGRMDGPRRPVKYEEDVNLGSGTRAVASCAEAPNMKIXGRRIERXRNEHAETWFLDENHPYRTWAYHGSYEAPTQGSASSLVNGVXRLXSKPXDVVTGVTGIAMTDTTPYGQQRVFKEKVDTRXPDPQEGTRQXXNIVSSWXWKELGKRKRPRVCTKEEFINKVRSNAALGAXFEEEKEWKTXVEXVNDPRXWALVDREREHHLRGEXHSXXXNMMGKREKKQGEFGKAKGSRAIWYXWXGXRFXEFEXLGXXNEDHXXGRENSGGGXEGLGLQRXGXIXEEXNRXPGGKXYADDTAGWDTRXSKFDLENEALITNQMEEGHRTLXLAXIKYTXQNKXXKXLRPAEGGKTXMDXXSRQDQRGSGQVXTYXXNTXTNXXXQXXRNXEAEEVLEXQDXWLLRKPEKXTRWXQSNGWDRXKRXXXSGDDCXXKPIDDRXAHXXRXXNDXGKVRKDTQEWKPSTGWSNWEEXPXCSHHXNKLYLKDGRSXXXPXRHQDELXGRXRVSPGXGWSIRETXCLXKSYXQMXQXLYXXRRDXRLXXNXXCSXXPXDWVPTGRTTWSIXGKGEWMTTEDMXMVXNRXXIEENDXMEDKTPVTKWTDXPYXGKREDLWCGSLIGHRPRTTWXENXKDTXNMVRRXIGDEEKYXDYXSTQVRYLGEEGSTPGVL

SEQ ID NO: 745 - protein, 1256 aa, Homo sapiens
  SITE (139)..(139): Xaa at position 139 is Leu, Ala, Val, Gly, or Ile
  SITE (154)..(154): Xaa at position 154 is Leu, Ala, Val, Gly, or Ile
  SITE (161)..(161): Xaa at position 161 is Phe, Tyr, Met, His, Ile, Leu, Val Ala, or Gly
  SITE (191)..(191): Xaa at position 191 is Val, Ala, Gly, Leu, or Ile
  SITE (228)..(228): Xaa at position 228 is Ala, Gly, or Pro
  SITE (230)..(230): Xaa at position 230 is Leu, Ala, Val, Gly, or Ile
  SITE (243)..(243): Xaa at position 243 is Leu, Ala, Val, Gly, or Ile
  SITE (251)..(251): Xaa at position 251 is Leu, Ala, Val, Gly, or Ile
  SITE (267)..(267): Xaa at position 267 is Ala, Gly, or Pro
  SITE (269)..(269): Xaa at position 269 is Leu, Ala, Val, Gly, or Ile
  SITE (271)..(271): Xaa at position 271 is Leu, Ala, Val, Gly, or Ile
  SITE (300)..(300): Xaa at position 300 is Ala, Gly, or Pro
MLFKLLQRQTYTCLSHRYGLYVCFLGVVVTIVSAFQFGEVVLEWSRDQYHVLFDSYRDNIAGKSFQNRLCLPMPIDVVYTWVNGTDLELLKELQQVREQMEEEQKAMREILGKNTTEPTKKSEKQLECLLTHCIKVPMXVLDPALPANITLKDXPSLYPSXHSASDIFNVAKPKNPSTNVSVVVFDSTKDXEDAHSGLLKGNSRQTVWRGYLTTDKEVPGLVLMQDLXFXSGFPPTFKETNQXKTKLPENXSSKVKLLQLYSEASVXLXKXNNPKDFQELNKQTKKNMTIDGKELTISPXYLLWDLSAISQSKQDEDISASRFEDNEELRYSLRSIERHAPWVRNIFIVTNGQIPSWLNLDNPRVTIVTHQDVFRNLSHLPTFSSPAIESHIHRIEGLSQKFIYLNDDVMFGKDVWPDDFYSHSKGQKVYLTWPVPNCAEGCPGSWIKDGYCDKACNNSACDWDGGDCSGNSGGSRYIAGGGGTGSIGVGQPWQFGGGINSVSYCNQGCANSWLADKFCDQACNVLSCGFDAGDCGQDHFHELYKVILLPNQTHYIIPKGECLPYFSFAEVAKRGVEGAYSDNPIIRHASIANKWKTIHLIMHSGMNATTIHFNLTFQNTNDEEFKMQITVEVDTREGPKLNSTAQKGYENLVSPITLLPEAEILFEDIPKEKRFPKFKRHDVNSTRRAQEEVKIPLVNISLLPKDAQLSLNTLDLQLEHGDITLKGYNLSKSALLRSFLMNSQHAKIKNQAIITDETNDSLVAPQEKQVHKSILPNSLGVSERLQRLTFPAVSVKVNGHDQGQNPPLDLETTARFRVETHTQKTIGGNVTKEKPPSLIVPLESQMTKEKKITGKEKENSRMEENAENHIGVTEVLLGRKLQHYTDSYLGFLPWEKKKYFQDLLDEEESLKTQLAYFTDSKNTGRQLKDTFADSLRYVNKILNSKFGFTSRKVPAHMPHMIDRIVMQELQDMFPEEFDKTSFHKVRHSEDMQFAFSYFYYLMSAVQPLNISQVFDEVDTDQSGVLSDREIRTLATRIHELPLSLQDLTGLEHMLINCSKMLPADITQLNNIPPTQESYYDPNLPPVTKSLVTNCKPVTDKIHKAYKDKNKYRFEIMGEEEIAFKMIRTNVSHVVGQLDDIRKNPRKFVCLNDNIDHNHKDAQTVKAVLRDFYESMFPIPSQFELPREYRNRFLHMHELQEWRAYRDKLKFWTHCVLATLIMFTIFSFFAEQLIALKRKIFPRRRIHKEASPNRIRV

SEQ ID NO: 746 - protein, 738 aa, Mus musculus
  SITE (127)..(127): Xaa at position 127 is Val, Ala, Gly, Leu, or Ile
  SITE (129)..(129): Xaa at position 129 is Leu, Ala, Val, Gly, or Ile
  SITE (130)..(130): Xaa at position 130 is Tyr, Phe, Met, His, Ile, Leu, Val Ala, or Gly
  SITE (131)..(131): Xaa at position 131 is Phe, Tyr, Met, His, Ile, Leu, Val Ala, or Gly
  SITE (132)..(132): Xaa at position 132 is Leu, Ala, Val, Gly, or Ile
  SITE (133)..(133): Xaa at position 133 is Met, Ile, Leu, Val, Ala, or Gly
  SITE (146)..(146): Xaa at position 146 is Val, Ala, Gly, Leu, or Ile
  SITE (149)..(149): Xaa at position 149 is Leu, Ala, Val, Gly, or Ile
  SITE (153)..(153): Xaa at position 153 is Leu, Ala, Val, Gly, or Ile
  SITE (154)..(154): Xaa at position 154 is Leu, Ala, Val, Gly, or Ile
  SITE (157)..(157): Xaa at position 157 is Leu, Ala, Val, Gly, or Ile
  SITE (166)..(166): Xaa at position 166 is Ile, Ala, Val, Leu, or Gly
  SITE (168)..(168): Xaa at position 168 is Phe, Tyr, Met, His, Ile, Leu, Val Ala, or Gly
  SITE (171)..(171): Xaa at position 171 is Ile, Ala, Val, Leu, or Gly
  SITE (176)..(176): Xaa at position 176 is Phe, Tyr, Met, His, Ile, Leu, Val Ala, or Gly
  SITE (189)..(189): Xaa at position 189 is Phe, Tyr, Met, His, Ile, Leu, Val Ala, or Gly
  SITE (193)..(193): Xaa at position 193 is Leu, Ala, Val, Gly, or Ile
  SITE (209)..(209): Xaa at position 209 is Leu, Ala, Val, Gly, or Ile
  SITE (211)..(211): Xaa at position 211 is Ala, Gly, or Pro
  SITE (212)..(212): Xaa at position 212 is Val, Ala, Gly, Leu, or Ile
  SITE (213)..(213): Xaa at position 213 is Val, Ala, Gly, Leu, or Ile
  SITE (215)..(215): Xaa at position 215 is Val, Ala, Gly, Leu, or Ile
  SITE (216)..(216): Xaa at position 216 is Ala, Gly, or Pro
  SITE (222)..(222): Xaa at position 222 is Ile, Ala, Val, Leu, or Gly
  SITE (231)..(231): Xaa at position 231 is Leu, Ala, Val, Gly, or Ile
  SITE (232)..(232): Xaa at position 232 is Val, Ala, Gly, Leu, or Ile
  SITE (233)..(233): Xaa at position 233 is Leu, Ala, Val, Gly, or Ile
  SITE (265)..(265): Xaa at position 265 is Tyr, Phe, Met, His, Ile, Leu, Val Ala, or Gly
  SITE (279)..(279): Xaa at position 279 is Leu, Ala, Val, Gly, or Ile
  SITE (291)..(291): Xaa at position 291 is Ile, Ala, Val, Leu, or Gly
  SITE (292)..(292): Xaa at position 292 is Phe, Tyr, Met, His, Ile, Leu, Val Ala, or Gly
  SITE (293)..(293): Xaa at position 293 is Val, Ala, Gly, Leu, or Ile
  SITE (294)..(294): Xaa at position 294 is Val, Ala, Gly, Leu, or Ile
  SITE (302)..(302): Xaa at position 302 is Tyr, Phe, Met, His, Ile, Leu, Val Ala, or Gly
  SITE (309)..(309): Xaa at position 309 is Ile, Ala, Val, Leu, or Gly
  SITE (324)..(324): Xaa at position 324 is Val, Ala, Gly, Leu, or Ile
  SITE (328)..(328): Xaa at position 328 is Ile, Ala, Val, Leu, or Gly
MLGQCTLLPVLAGLLSLESALSQLCTKDNVSTCQDCIRSGPSCAWCQKLNFTGRGEPDSVRCDTPEQLLLKGCTSEYLVDPKSLAESQEDKERDQRQLSPRNVTVFLRPGQAATFKVDFQRTQDNSXDXXXXXGLSGSAQGHLSNXQTXGSDXXKAXNEISRSGRXGXGSXVNMTXQHILKLTADSSQXQREXRKQLVSGKLATPKGQXDXXXQXXICLGEXGWRNGTRFXXXVTDNDFHLAKDKTLGTRQNTSDGRCHLDDGMXRSRGEPDYQSVVQXASKLAENNIQPXXXXPSRMVKTXEKLTTFXPKLTIGELSDDSSNXAQLXRNAYSKLSSIVVLNHSTIPSILKVTYDSYCSNGTSNPGKPSGDCSGVQINDQVTFQVNITASECFREQFFFIQALGFMDSVTVRVLPLCECQCQEQSQHHSLCGGKGAMECGICRCNSGYAGKNCECQTQGPSSQDLEGSCRKDNSSIMCSGLGDCICGQCECHTSDIPNKEIYGQYCECNNVNCERYDGQVCGGPERGHCSCGRCFCRYGFVGSACQCRMSTSGCLNNRMVECSGHGRCYCNRCLCDPGYQPPLCEKRPGYFHRCSEYYSCARCLKDNSAIKCRECWNLLFSNTPFSNKTCMTERDSEGCWTTYTLYQPDQSDINSIYIKESLVCAEISNTTILLGVIVGVLLAVIFLLVYCMVYLKGTQKAAKLPRKGGAQSTLAQQPHFQEPHHVEPVWNQERQGTQ

SEQ ID NO: 747 - protein, 659 aa, Bos taurus
  SITE (10)..(10): Xaa at position 10 is Phe, Tyr, Met, His, Ile, Leu, Val Ala, or Gly
  SITE (11)..(11): Xaa at position 11 is Leu, Ala, Val, Gly, or Ile
  SITE (30)..(30): Xaa at position 30 is Phe, Tyr, Met, His, Ile, Leu, Val Ala, or Gly
  SITE (31)..(31): Xaa at position 31 is Leu, Ala, Val, Gly, or Ile
  SITE (32)..(32): Xaa at position 32 is Leu, Ala, Val, Gly, or Ile
  SITE (37)..(37): Xaa at position 37 is Leu, Ala, Val, Gly, or Ile
  SITE (61)..(61): Xaa at position 61 is Ile, Ala, Val, Leu, or Gly
  SITE (63)..(63): Xaa at position 63 is Cys, Ala, Val, Gly, Ser, or Thr
  SITE (64)..(64): Xaa at position 64 is Val, Ala, Gly, Leu, or Ile
  SITE (67)..(67): Xaa at position 67 is Val, Ala, Gly, Leu, or Ile
  SITE (98)..(98): Xaa at position 98 is Phe, Tyr, Met, His, Ile, Leu, Val Ala, or Gly
  SITE (102)..(102): Xaa at position 102 is Phe, Tyr, Met, His, Ile, Leu, Val Ala, or Gly
  SITE (104)..(104): Xaa at position 104 is Val, Ala, Gly, Leu, or Ile
  SITE (112)..(112): Xaa at position 112 is Tyr, Phe, Met, His, Ile, Leu, Val Ala, or Gly
  SITE (113)..(113): Xaa at position 113 is Val, Ala, Gly, Leu, or Ile
  SITE (114)..(114): Xaa at position 114 is Phe, Tyr, Met, His, Ile, Leu, Val Ala, or Gly
  SITE (124)..(124): Xaa at position 124 is Trp, Tyr, Phe, Met, His, Ile, Leu Val, Ala, or Gly
  SITE (128)..(128): Xaa at position 128 is Leu, Ala, Val, Gly, or Ile
  SITE (384)..(384): Xaa at position 384 is Ala, Gly, or Pro
  SITE (427)..(427): Xaa at position 427 is Val, Ala, Gly, Leu, or Ile
  SITE (429)..(429): Xaa at position 429 is Ile, Ala, Val, Leu, or Gly
  SITE (432)..(432): Xaa at position 432 is Ile, Ala, Val, Leu, or Gly
  SITE (442)..(442): Xaa at position 442 is Phe, Tyr, Met, His, Ile, Leu, Val Ala, or Gly
  SITE (446)..(446): Xaa at position 446 is Ala, Gly, or Pro
  SITE (450)..(450): Xaa at position 450 is Met, Ile, Leu, Val, Ala, or Gly
  SITE (457)..(457): Xaa at position 457 is Leu, Ala, Val, Gly, or Ile
  SITE (463)..(463): Xaa at position 463 is Val, Ala, Gly, Leu, or Ile
  SITE (464)..(464): Xaa at position 464 is Cys, Ala, Val, Gly, Ser, or Thr
  SITE (470)..(470): Xaa at position 470 is Ile, Ala, Val, Leu, or Gly
  SITE (473)..(473): Xaa at position 473 is Ile, Ala, Val, Leu, or Gly
  SITE (482)..(482): Xaa at position 482 is Leu, Ala, Val, Gly, or Ile
  SITE (486)..(486): Xaa at position 486 is Leu, Ala, Val, Gly, or Ile
  SITE (498)..(498): Xaa at position 498 is Leu, Ala, Val, Gly, or Ile
  SITE (499)..(499): Xaa at position 499 is Leu, Ala, Val, Gly, or Ile
  SITE (502)..(502): Xaa at position 502 is Cys, Ala, Val, Gly, Ser, or Thr
  SITE (505)..(505): Xaa at position 505 is Val, Ala, Gly, Leu, or Ile
  SITE (506)..(506): Xaa at position 506 is Cys, Ala, Val, Gly, Ser, or Thr
  SITE (508)..(508): Xaa at position 508 is Ala, Gly, or Pro
  SITE (509)..(509): Xaa at position 509 is Met, Ile, Leu, Val, Ala, or Gly
  SITE (512)..(512): Xaa at position 512 is Leu, Ala, Val, Gly, or Ile
  SITE (519)..(519): Xaa at position 519 is His, Phe, Tyr, Lys, Arg, Gly, Ser Thr, Ala, Val, Leu, Ile, Asn, Met, or Gln
  SITE (522)..(522): Xaa at position 522 is Leu, Ala, Val, Gly, or Ile
  SITE (523)..(523): Xaa at position 523 is Ala, Gly, or Pro
  SITE (524)..(524): Xaa at position 524 is Ala, Gly, or Pro
  SITE (527)..(527): Xaa at position 527 is Cys, Ala, Val, Gly, Ser, or Thr
  SITE (529)..(529): Xaa at position 529 is Val, Ala, Gly, Leu, or Ile
  SITE (535)..(535): Xaa at position 535 is Val, Ala, Gly, Leu, or Ile
  SITE (537)..(537): Xaa at position 537 is Val, Ala, Gly, Leu, or Ile
  SITE (545)..(545): Xaa at position 545 is Tyr, Phe, Met, His, Ile, Leu, Val Ala, or Gly
  SITE (561)..(561): Xaa at position 561 is Val, Ala, Gly, Leu, or Ile
  SITE (568)..(568): Xaa at position 568 is Val, Ala, Gly, Leu, or Ile
  SITE (580)..(580): Xaa at position 580 is Ile, Ala, Val, Leu, or Gly
  SITE (581)..(581): Xaa at position 581 is Trp, Tyr, Phe, Met, His, Ile, Leu Val, Ala, or Gly
  SITE (583)..(583): Xaa at position 583 is Phe, Tyr, Met, His, Ile, Leu, Val Ala, or Gly
  SITE (585)..(585): Xaa at position 585 is Val, Ala, Gly, Leu, or Ile
  SITE (586)..(586): Xaa at position 586 is Leu, Ala, Val, Gly, or Ile
  SITE (587)..(587): Xaa at position 587 is Met, Ile, Leu, Val, Ala, or Gly
  SITE (590)..(590): Xaa at position 590 is Ile, Ala, Val, Leu, or Gly
  SITE (591)..(591): Xaa at position 591 is Tyr, Phe, Met, His, Ile, Leu, Val Ala, or Gly
  SITE (610)..(610): Xaa at position 610 is Ile, Ala, Val, Leu, or Gly
  SITE (616)..(616): Xaa at position 616 is Leu, Ala, Val, Gly, or Ile
  SITE (622)..(622): Xaa at position 622 is Ala, Gly, or Pro
  SITE (626)..(626): Xaa at position 626 is Val, Ala, Gly, Leu, or Ile
  SITE (629)..(629): Xaa at position 629 is Ile, Ala, Val, Leu, or Gly
  SITE (630)..(630): Xaa at position 630 is Met, Ile, Leu, Val, Ala, or Gly
  SITE (633)..(633): Xaa at position 633 is Cys, Ala, Val, Gly, Ser, or Thr
  SITE (634)..(634): Xaa at position 634 is Trp, Tyr, Phe, Met, His, Ile, Leu Val, Ala, or Gly
  SITE (644)..(644): Xaa at position 644 is Phe, Tyr, Met, His, Ile, Leu, Val Ala, or Gly
  SITE (647)..(647): Xaa at position 647 is Leu, Ala, Val, Gly, or Ile
  SITE (651)..(651): Xaa at position 651 is Ile, Ala, Val, Leu, or Gly
  SITE (654)..(654): Xaa at position 654 is Val, Ala, Gly, Leu, or Ile
MATVILESIXXKRSQQKKKTSPLNFKKRLXXXTVQKXSYYEYDFERGRRGSKKGSIDVEKXTXXETXVPEKNPPPERQIPRRGEESSETEQISIIERXPYPXQXVYDEGPLXXXSPTEELRKRXIHQXKNVIRYNSDLVQKYHPCFWIDGQYLCCSQTAKNAMGCQILENRNGSLKPGSSHRKTKKPLPPTPEEDQILKKPLPPEPTAAPVSTSELKKVVALYDYMPMNANDLQLHKGNEYFILEESNLPWWRARDKNGQEGYIPSNYVTEAEDSIEMYEWYSKHMTRSQAEQLLKQEGKEGGFIVRDSSKAGKYTVSVFAKSTGEPQGVIRHYVVCSTPQSQYYLAEKHLFSTIPELINYHQHNSAGLISRLKYPVSQQNKNXPSTAGLGYGSWEIDPKDLTFLKELGTGQFGVVKYGKWRGQYDXAXKMXKEGSMSEDEXIEEXKVMXNLSHEKXVQLYGXXTKQRPXFIXTEYMANGCXLNYXREMRHRFQTQQXXEMXKDXXEXXEYXESKQFLXRDXXXRNXLXNDQGVXKXSDFGLSRXVLDDEYTSSVGSKFPXRWSPPEXLMYSKFSSKSDXXAXGXXXWEXXSLGKMPYERFTNSETAEHXAQGLRXYRPHLXSERXYAXXYSXXHEKADERPTXKIXLSNXLDXMDEES

SEQ ID NO: 748 - protein, 857 aa, Human immunodeficiency virus 1
  SITE (54)..(54): Xaa at position 54 is Ala, Gly, or Pro
  SITE (65)..(65): Xaa at position 65 is His, Phe, Tyr, Lys, Arg, Gly, Ser Thr, Ala, Val, Leu, Ile, Asn, Met, or Gln
  SITE (69)..(69): Xaa at position 69 is Ala, Gly, or Pro
  SITE (94)..(94): Xaa at position 94 is Val, Ala, Gly, Leu, or Ile
  SITE (100)..(100): Xaa at position 100 is Val, Ala, Gly, Leu, or Ile
  SITE (103)..(103): Xaa at position 103 is Met, Ile, Leu, Val, Ala, or Gly
  SITE (119)..(119): Xaa at position 119 is Val, Ala, Gly, Leu, or Ile
  SITE (150)..(150): Xaa at position 150 is Ile, Ala, Val, Leu, or Gly
  SITE (189)..(189): Xaa at position 189 is Leu, Ala, Val, Gly, or Ile
  SITE (214)..(214): Xaa at position 214 is Cys, Ala, Val, Gly, Ser, or Thr
  SITE (220)..(220): Xaa at position 220 is Ala, Gly, or Pro
  SITE (221)..(221): Xaa at position 221 is Ile, Ala, Val, Leu, or Gly
  SITE (224)..(224): Xaa at position 224 is Cys, Ala, Val, Gly, Ser, or Thr
  SITE (235)..(235): Xaa at position 235 is Cys, Ala, Val, Gly, Ser, or Thr
  SITE (238)..(238): Xaa at position 238 is Val, Ala, Gly, Leu, or Ile
  SITE (247)..(247): Xaa at position 247 is Ile, Ala, Val, Leu, or Gly
  SITE (255)..(255): Xaa at position 255 is Leu, Ala, Val, Gly, or Ile
  SITE (266)..(266): Xaa at position 266 is Ile, Ala, Val, Leu, or Gly
  SITE (280)..(280): Xaa at position 280 is Ile, Ala, Val, Leu, or Gly
  SITE (281)..(281): Xaa at position 281 is Ile, Ala, Val, Leu, or Gly
  SITE (282)..(282): Xaa at position 282 is Val, Ala, Gly, Leu, or Ile
  SITE (284)..(284): Xaa at position 284 is Leu, Ala, Val, Gly, or Ile
  SITE (288)..(288): Xaa at position 288 is Val, Ala, Gly, Leu, or Ile
  SITE (290)..(290): Xaa at position 290 is Ile, Ala, Val, Leu, or Gly
  SITE (293)..(293): Xaa at position 293 is Ala, Gly, or Pro
  SITE (321)..(321): Xaa at position 321 is Ile, Ala, Val, Leu, or Gly
  SITE (326)..(326): Xaa at position 326 is Cys, Ala, Val, Gly, Ser, or Thr
  SITE (328)..(328): Xaa at position 328 is Val, Ala, Gly, Leu, or Ile
  SITE (333)..(333): Xaa at position 333 is Trp, Tyr, Phe, Met, His, Ile, Leu Val, Ala, or Gly
  SITE (337)..(337): Xaa at position 337 is Leu, Ala, Val, Gly, or Ile
  SITE (340)..(340): Xaa at position 340 is Val, Ala, Gly, Leu, or Ile
  SITE (341)..(341): Xaa at position 341 is Ala, Gly, or Pro
  SITE (342)..(342): Xaa at position 342 is Ile, Ala, Val, Leu, or Gly
  SITE (344)..(344): Xaa at position 344 is Leu, Ala, Val, Gly, or Ile
  SITE (352)..(352): Xaa at position 352 is Ile, Ala, Val, Leu, or Gly
  SITE (353)..(353): Xaa at position 353 is Ile, Ala, Val, Leu, or Gly
  SITE (354)..(354): Xaa at position 354 is Phe, Tyr, Met, His, Ile, Leu, Val Ala, or Gly
  SITE (367)..(367): Xaa at position 367 is His, Phe, Tyr, Lys, Arg, Gly, Ser Thr, Ala, Val, Leu, Ile, Asn, Met, or Gln
  SITE (371)..(371): Xaa at position 371 is Cys, Ala, Val, Gly, Ser, or Thr
  SITE (376)..(376): Xaa at position 376 is Phe, Tyr, Met, His, Ile, Leu, Val Ala, or Gly
  SITE (378)..(378): Xaa at position 378 is Cys, Ala, Val, Gly, Ser, or Thr
  SITE (383)..(383): Xaa at position 383 is Leu, Ala, Val, Gly, or Ile
  SITE (384)..(384): Xaa at position 384 is Phe, Tyr, Met, His, Ile, Leu, Val Ala, or Gly
  SITE (407)..(407): Xaa at position 407 is Leu, Ala, Val, Gly, or Ile
  SITE (409)..(409): Xaa at position 409 is Cys, Ala, Val, Gly, Ser, or Thr
  SITE (411)..(411): Xaa at position 411 is Ile, Ala, Val, Leu, or Gly
  SITE (414)..(414): Xaa at position 414 is Ile, Ala, Val, Leu, or Gly
  SITE (415)..(415): Xaa at position 415 is Ile, Ala, Val, Leu, or Gly
  SITE (421)..(421): Xaa at position 421 is Val, Ala, Gly, Leu, or Ile
  SITE (424)..(424): Xaa at position 424 is Ala, Gly, or Pro
  SITE (425)..(425): Xaa at position 425 is Met, Ile, Leu, Val, Ala, or Gly
  SITE (440)..(440): Xaa at position 440 is Ile, Ala, Val, Leu, or Gly
  SITE (444)..(444): Xaa at position 444 is Leu, Ala, Val, Gly, or Ile
  SITE (445)..(445): Xaa at position 445 is Leu, Ala, Val, Gly, or Ile
  SITE (462)..(462): Xaa at position 462 is Phe, Tyr, Met, His, Ile, Leu, Val Ala, or Gly
  SITE (473)..(473): Xaa at position 473 is Trp, Tyr, Phe, Met, His, Ile, Leu Val, Ala, or Gly
  SITE (477)..(477): Xaa at position 477 is Leu, Ala, Val, Gly, or Ile
  SITE (483)..(483): Xaa at position 483 is Val, Ala, Gly, Leu, or Ile
  SITE (485)..(485): Xaa at position 485 is Ile, Ala, Val, Leu, or Gly
  SITE (499)..(499): Xaa at position 499 is Val, Ala, Gly, Leu, or Ile
  SITE (542)..(542): Xaa at position 542 is Ile, Ala, Val, Leu, or Gly
  SITE (543)..(543): Xaa at position 543 is Val, Ala, Gly, Leu, or Ile
  SITE (549)..(549): Xaa at position 549 is Leu, Ala, Val, Gly, or Ile
  SITE (550)..(550): Xaa at position 550 is Leu, Ala, Val, Gly, or Ile
  SITE (552)..(552): Xaa at position 552 is Ala, Gly, or Pro
  SITE (553)..(553): Xaa at position 553 is Ile, Ala, Val, Leu, or Gly
  SITE (555)..(555): Xaa at position 555 is Ala, Gly, or Pro
  SITE (559)..(559): Xaa at position 559 is Leu, Ala, Val, Gly, or Ile
  SITE (560)..(560): Xaa at position 560 is Leu, Ala, Val, Gly, or Ile
  SITE (564)..(564): Xaa at position 564 is Val, Ala, Gly, Leu, or Ile
  SITE (567)..(567): Xaa at position 567 is Ile, Ala, Val, Leu, or Gly
  SITE (570)..(570): Xaa at position 570 is Leu, Ala, Val, Gly, or Ile
  SITE (574)..(574): Xaa at position 574 is Val, Ala, Gly, Leu, or Ile
  SITE (629)..(629): Xaa at position 629 is Ile, Ala, Val, Leu, or Gly
  SITE (636)..(636): Xaa at position 636 is Ile, Ala, Val, Leu, or Gly
MRVMGIQRNCQHLLRWGTMILGMIIICSTAEDLWVTVYYGVPVWKNAETTLFCXSDAKAYKTEVXNVWXTHACVPTDPNPQEIHLENVTEEFNXWKNNMXEQXHTDIISLWDQSLKPCXKLTPLCVTLNCINANVTNSSMTNSSMMEGEXKNCSYNMTTELRDKKRKVFSLFYKLDVVPMNENNSEYRXINCNTSAITQACPKVTFEPIPIHYXAPAGFXXLKXKDEEFNGTGLXKNXSTVQCTHGXKPVVSTQXLLNGSLAEKEXRIKSENISDNAKTXXXQXTKPXLXNCXRPSNNTRKSVHIGPGQAFYATGAITGDXRQAYXVXNRTQXNDTXGQXXXQXRKHWNTTXXXNEPSGGDLEITTXSFNXGGEFXYXNTSDXXNSTWNIEGTASINGTESNDNITXPXRXKQXXNMWQRXGQXXYAPPIQGVIRCQSNXTGIXXTRDGGNTGNNSRTNETXRPGGGDMRDNXRSEXYKYKVXKXEPLGVAPTKAKRRXVEREKRAVGLGAVFIGFLGAAGSTMGAASITLTVQARQLLSGXXQQQSNXXRXXEXQQHXXKLTXWGXKQXQARXLAVERYLKDQQLLGIWGCSGKLICTTNVPWNSSWSNKSYNEIWENMTWLQWDKEXNNYTELXYSLIEESQNQQEKNEQDLLALDKWASLWNWFDISNWLWYIKIFIMIVGGLIGLRIVVAVLSVINRVRQGYSPLSFQTHTPNPRGLDRPERIEEEGGEQDRTRSTRLVSGFLALAWDDLRSLSLFLYHRLRDFILIAARTVELLGHSSLKGLRLGWEGLKYLWNLLLYWGRELKISAINLLNTIAIAVAGWTDRVIEIGQGIGRAILHIPRRIRQGFERALL

SEQ ID NO: 749 - protein, 2364 aa, Clostridium sordellii
  SITE (9)..(9): Xaa at position 9 is Leu, Ala, Val, Gly, or Ile
  SITE (13)..(13): Xaa at position 13 is Val, Ala, Gly, Leu, or Ile
  SITE (24)..(24): Xaa at position 24 is Tyr, Phe, Met, His, Ile, Leu, Val Ala, or Gly
  SITE (27)..(27): Xaa at position 27 is Ile, Ala, Val, Leu, or Gly
  SITE (31)..(31): Xaa at position 31 is Leu, Ala, Val, Gly, or Ile
  SITE (46)..(46): Xaa at position 46 is Tyr, Phe, Met, His, Ile, Leu, Val Ala, or Gly
  SITE (49)..(49): Xaa at position 49 is Leu, Ala, Val, Gly, or Ile
  SITE (52)..(52): Xaa at position 52 is Ile, Ala, Val, Leu, or Gly
  SITE (59)..(59): Xaa at position 59 is Tyr, Phe, Met, His, Ile, Leu, Val Ala, or Gly
  SITE (72)..(72): Xaa at position 72 is Leu, Ala, Val, Gly, or Ile
  SITE (75)..(75): Xaa at position 75 is Phe, Tyr, Met, His, Ile, Leu, Val Ala, or Gly
  SITE (79)..(79): Xaa at position 79 is Leu, Ala, Val, Gly, or Ile
  SITE (83)..(83): Xaa at position 83 is Val, Ala, Gly, Leu, or Ile
  SITE (98)..(98): Xaa at position 98 is Leu, Ala, Val, Gly, or Ile
  SITE (99)..(99): Xaa at position 99 is His, Phe, Tyr, Lys, Arg, Gly, Ser Thr, Ala, Val, Leu, Ile, Asn, Met, or Gln
  SITE (100)..(100): Xaa at position 100 is Phe, Tyr, Met, His, Ile, Leu, Val Ala, or Gly
  SITE (114)..(114): Xaa at position 114 is Tyr, Phe, Met, His, Ile, Leu, Val Ala, or Gly
  SITE (118)..(118): Xaa at position 118 is Trp, Tyr, Phe, Met, His, Ile, Leu Val, Ala, or Gly
  SITE (129)..(129): Xaa at position 129 is Val, Ala, Gly, Leu, or Ile
  SITE (135)..(135): Xaa at position 135 is Ala, Gly, or Pro
  SITE (137)..(137): Xaa at position 137 is Leu, Ala, Val, Gly, or Ile
  SITE (138)..(138): Xaa at position 138 is Ile, Ala, Val, Leu, or Gly
  SITE (141)..(141): Xaa at position 141 is Leu, Ala, Val, Gly, or Ile
  SITE (145)..(145): Xaa at position 145 is Ile, Ala, Val, Leu, or Gly
  SITE (149)..(149): Xaa at position 149 is Ala, Gly, or Pro
  SITE (171)..(171): Xaa at position 171 is Phe, Tyr, Met, His, Ile, Leu, Val Ala, or Gly
  SITE (176)..(176): Xaa at position 176 is Met, Ile, Leu, Val, Ala, or Gly
  SITE (179)..(179): Xaa at position 179 is Ile, Ala, Val, Leu, or Gly
  SITE (186)..(186): Xaa at position 186 is Phe, Tyr, Met, His, Ile, Leu, Val Ala, or Gly
  SITE (206)..(206): Xaa at position 206 is Ile, Ala, Val, Leu, or Gly
  SITE (210)..(210): Xaa at position 210 is Leu, Ala, Val, Gly, or Ile
  SITE (254)..(254): Xaa at position 254 is Leu, Ala, Val, Gly, or Ile
  SITE (259)..(259): Xaa at position 259 is Leu, Ala, Val, Gly, or Ile
  SITE (260)..(260): Xaa at position 260 is Val, Ala, Gly, Leu, or Ile
  SITE (267)..(267): Xaa at position 267 is Ala, Gly, or Pro
  SITE (268)..(268): Xaa at position 268 is Ala, Gly, or Pro
  SITE (274)..(274): Xaa at position 274 is Ile, Ala, Val, Leu, or Gly
  SITE (277)..(277): Xaa at position 277 is Leu, Ala, Val, Gly, or Ile
  SITE (283)..(283): Xaa at position 283 is Val, Ala, Gly, Leu, or Ile
  SITE (284)..(284): Xaa at position 284 is Tyr, Phe, Met, His, Ile, Leu, Val Ala, or Gly
  SITE (285)..(285): Xaa at position 285 is Leu, Ala, Val, Gly, or Ile
  SITE (289)..(289): Xaa at position 289 is Ile, Ala, Val, Leu, or Gly
  SITE (290)..(290): Xaa at position 290 is Leu, Ala, Val, Gly, or Ile
  SITE (317)..(317): Xaa at position 317 is Leu, Ala, Val, Gly, or Ile
  SITE (319)..(319): Xaa at position 319 is Ala, Gly, or Pro
  SITE (320)..(320): Xaa at position 320 is Ile, Ala, Val, Leu, or Gly
  SITE (335)..(335): Xaa at position 335 is Phe, Tyr, Met, His, Ile, Leu, Val Ala, or Gly
  SITE (346)..(346): Xaa at position 346 is Phe, Tyr, Met, His, Ile, Leu, Val Ala, or Gly
  SITE (359)..(359): Xaa at position 359 is Ile, Ala, Val, Leu, or Gly
  SITE (360)..(360): Xaa at position 360 is Phe, Tyr, Met, His, Ile, Leu, Val Ala, or Gly
  SITE (363)..(363): Xaa at position 363 is Leu, Ala, Val, Gly, or Ile
  SITE (368)..(368): Xaa at position 368 is Val, Ala, Gly, Leu, or Ile
  SITE (371)..(371): Xaa at position 371 is Leu, Ala, Val, Gly, or Ile
  SITE (373)..(373): Xaa at position 373 is Val, Ala, Gly, Leu, or Ile
  SITE (375)..(375): Xaa at position 375 is Ile, Ala, Val, Leu, or Gly
  SITE (376)..(376): Xaa at position 376 is Ala, Gly, or Pro
  SITE (386)..(386): Xaa at position 386 is Ala, Gly, or Pro
  SITE (387)..(387): Xaa at position 387 is Leu, Ala, Val, Gly, or Ile
  SITE (388)..(388): Xaa at position 388 is Ile, Ala, Val, Leu, or Gly
  SITE (395)..(395): Xaa at position 395 is Cys, Ala, Val, Gly, Ser, or Thr
  SITE (399)..(399): Xaa at position 399 is Val, Ala, Gly, Leu, or Ile
  SITE (403)..(403): Xaa at position 403 is Ile, Ala, Val, Leu, or Gly
  SITE (407)..(407): Xaa at position 407 is Tyr, Phe, Met, His, Ile, Leu, Val Ala, or Gly
  SITE (410)..(410): Xaa at position 410 is Leu, Ala, Val, Gly, or Ile
  SITE (431)..(431): Xaa at position 431 is Phe, Tyr, Met, His, Ile, Leu, Val Ala, or Gly
  SITE (450)..(450): Xaa at position 450 is Ile, Ala, Val, Leu, or Gly
  SITE (454)..(454): Xaa at position 454 is Leu, Ala, Val, Gly, or Ile
  SITE (458)..(458): Xaa at position 458 is Phe, Tyr, Met, His, Ile, Leu, Val Ala, or Gly
  SITE (468)..(468): Xaa at position 468 is Leu, Ala, Val, Gly, or Ile
  SITE (473)..(473): Xaa at position 473 is Val, Ala, Gly, Leu, or Ile
  SITE (474)..(474): Xaa at position 474 is Tyr, Phe, Met, His, Ile, Leu, Val Ala, or Gly
  SITE (477)..(477): Xaa at position 477 is Ala, Gly, or Pro
  SITE (478)..(478): Xaa at position 478 is Tyr, Phe, Met, His, Ile, Leu, Val Ala, or Gly
  SITE (481)..(481): Xaa at position 481 is Leu, Ala, Val, Gly, or Ile
  SITE (501)..(501): Xaa at position 501 is Phe, Tyr, Met, His, Ile, Leu, Val Ala, or Gly
  SITE (527)..(527): Xaa at position 527 is Ala, Gly, or Pro
MNLVNKAQXQKMXYVKFRIQEDEXVAXLNAXEEYHNMSESSVVEKXLKXKDXNNLTDNXLNTYKKSGRNKAXKKXKEYXTMEXLELKNNSLTPVEKNXXXIWIGGQINDTAINXINQXKDVNSDYTVKXFYDSNXFXXNTXKKTXVESXTNNTLESFRENLNDPEFDYNKXYRKRXEIXYDKQKHXIDYYKSQIEENPEFIIDNIXKTYXSNEYSKDLEALNKYIEESLNKITANNGNDIRNLEKFADEDLVRXYNQEXXERWNLAXXSDILRXSMXKEDGGXXXDVDXXPGIQPDLFKSINKPDSITNTSWEMIKXEXXMKYKEYIPGYTSKNXDMLDEEVQRSXESALSSKSDKSEXXLPXDDIKXSPXEXKXXFANNSVINQXXXSLKDSYXSDLXINQXKNRXKIXNDNLNPSINEGTDFNTTMKIXSDKLASISNEDNMMFMIKXTNYXKVGXAPDVRSTINXSGPGXXTGXXQDXLMFKDNSTNIHLLEPELRNXEFPKTKISQLTEQEITSLWSFNQARXKSQFEEYKKGYFEGALGEDDNLDFAQNTVLDKDYVSKKILSSMKTRNKEYIHYIVQLQGDKISYEASCNLFSKDPYSSILYQKNIEGSETAYYYYVADAEIKEIDKYRIPYQISNKRNIKLTFIGHGKSEFNTDTFANLDVDSLSSEIETILNLAKADISPKYIEINLLGCNMFSYSISAEETYPGKLLLKIKDRVSELMPSISQDSITVSANQYEVRINEEGKREILDHSGKWINKEESIIKDISSKEYISFNPKENKIIVKSKYLHELSTLLQEIRNNANSSDIDLEKKVMLTECEINVASNIDRQIVEGRIEEAKNLTSDSINYIKNEFKLIESISDSLYDLKHQNGLDDSHFISFEDISKTENGFRIRFINKETGNSIFIETEKEIFSEYATHISKEISNIKDTIFDNVNGKLVKKVNLDAAHEVNTLNSAFFIQSLIEYNTTKESLSNLSVAMKVQVYAQLFSTGLNTITDASKVVELVSTALDETIDLLPTLSEGLPIIATIIDGVSLGAAIKELSETNDPLLRQEIEAKIGIMAVNLTAASTAIVTSALGIASGFSILLVPLAGISAGIPSLVNNELILQDKATKVIDYFKHISLAETEGAFTLLDDKIIMPQDDLVLSEIDFNNNSITLGKCEIWRAEGGSGHTLTDDIDHFFSSPSITYRKPWLSIYDVLNIKKEKIDFSKDLMVLPNAPNRVFGYEMGWTPGFRSLDNDGTKLLDRIRDHYEGQFYWRYFAFIADALITKLKPRYEDTNVRINLDGNTRSFIVPVITTEQIRKNLSYSFYGSGGSYSLSLSPYNMNIDLNLVENDTWVIDVDNVVKNITIESDEIQKGELIENILSKLNIEDNKIILNNHTINFYGDINESNRFISLTFSILEDINIIIEIDLVSKSYKILLSGNCMKLIENSSDIQQKIDHIGFNGEHQKYIPYSYIDNETKYNGFIDYSKKEGLFTAEFSNESIIRNIYMPDSNNLFIYSSKDLKDIRIINKGDVKLLIGNYFKDDMKVSLSFTIEDTNTIKLNGVYLDENGVAQILKFMNNAKSALNTSNSLMNFLESINIKNIFYNNLDPNIEFILDTNFIISGSNSIGQFELICDKDKNIQPYFINFKIKETSYTLYVGNRQNLIVEPSYHLDDSGNISSTVINFSQKYLYGIDRYVNKVIIAPNLYTDEINITPVYKPNYICPEVIILDANYINEKINVNINDLSIRYVWDNDGSDLILIANSEEDNQPQVKIRFVNVFKSDTAADKLSFNFSDKQDVSVSKIISTFSLAAYSDGFFDYEFGLVSLDNDYFYINSFGNMVSGLIYINDSLYYFKPPKNNLITGFTTIDGNKYYFDPTKSGAASIGEITIDGKDYYFNKQGILQVGVINTSDGLKYFAPAGTLDENLEGESVNFIGKLNIDGKIYYFEDNYRAAVEWKLLDDETYYFNPKTGEALKGLHQIGDNKYYFDDNGIMQTGFITINDKVFYFNNDGVMQVGYIEVNGKYFYFGKNGERQLGVFNTPDGFKFFGPKDDDLGTEEGELTLYNGILNFNGKIYFFDISNTAVVGWGTLDDGSTYYFDDNRAEACIGLTVINDCKYYFDDNGIRQLGFITINDNIFYFSESGKIELGYQNINGNYFYIDESGLVLIGVFDTPDGYKYFAPLNTVNDNIYGQAVKYSGLVRVNEDVYYFGETYKIETGWIENETDKYYFDPETKKAYKGINVVDDIKYYFDENGIMRTGLISFENNNYYFNEDGKMQFGYLNIKDKMFYFGKDGKMQIGVFNTPDGFKYFAHQNTLDENFEGESINYTGWLDLDGKRYYFTDEYIAATGSLTIDGYNYYFDPDTAELVVSE

SEQ ID NO: 750 - protein, 208 aa, Human immunodeficiency virus 1
  SITE (13)..(13): Xaa at position 13 is Ile, Ala, Val, Leu, or Gly
  SITE (15)..(15): Xaa at position 15 is Val, Ala, Gly, Leu, or Ile
  SITE (17)..(17): Xaa at position 17 is Leu, Ala, Val, Gly, or Ile
  SITE (21)..(21): Xaa at position 21 is Val, Ala, Gly, Leu, or Ile
  SITE (23)..(23): Xaa at position 23 is Ile, Ala, Val, Leu, or Gly
  SITE (53)..(53): Xaa at position 53 is Ile, Ala, Val, Leu, or Gly
  SITE (58)..(58): Xaa at position 58 is Cys, Ala, Val, Gly, Ser, or Thr
  SITE (60)..(60): Xaa at position 60 is Ile, Ala, Val, Leu, or Gly
  SITE (69)..(69): Xaa at position 69 is Leu, Ala, Val, Gly, or Ile
  SITE (72)..(72): Xaa at position 72 is Val, Ala, Gly, Leu, or Ile
  SITE (74)..(74): Xaa at position 74 is Ala, Gly, or Pro
  SITE (76)..(76): Xaa at position 76 is Leu, Ala, Val, Gly, or Ile
  SITE (84)..(84): Xaa at position 84 is Ile, Ala, Val, Leu, or Gly
  SITE (85)..(85): Xaa at position 85 is Val, Ala, Gly, Leu, or Ile
  SITE (99)..(99): Xaa at position 99 is His, Phe, Tyr, Lys, Arg, Gly, Ser Thr, Ala, Val, Leu, Ile, Asn, Met, or Gln
  SITE (108)..(108): Xaa at position 108 is Phe, Tyr, Met, His, Ile, Leu, Val Ala, or Gly
  SITE (110)..(110): Xaa at position 110 is Cys, Ala, Val, Gly, Ser, or Thr
  SITE (115)..(115): Xaa at position 115 is Leu, Ala, Val, Gly, or Ile
  SITE (116)..(116): Xaa at position 116 is Phe, Tyr, Met, His, Ile, Leu, Val Ala, or Gly
  SITE (127)..(127): Xaa at position 127 is Ile, Ala, Val, Leu, or Gly
  SITE (129)..(129): Xaa at position 129 is Leu, Ala, Val, Gly, or Ile
  SITE (131)..(131): Xaa at position 131 is Cys, Ala, Val, Gly, Ser, or Thr
  SITE (136)..(136): Xaa at position 136 is Ile, Ala, Val, Leu, or Gly
  SITE (137)..(137): Xaa at position 137 is Ile, Ala, Val, Leu, or Gly
  SITE (143)..(143): Xaa at position 143 is Val, Ala, Gly, Leu, or Ile
  SITE (146)..(146): Xaa at position 146 is Ala, Gly, or Pro
  SITE (147)..(147): Xaa at position 147 is Met, Ile, Leu, Val, Ala, or Gly
  SITE (162)..(162): Xaa at position 162 is Ile, Ala, Val, Leu, or Gly
  SITE (165)..(165): Xaa at position 165 is Leu, Ala, Val, Gly, or Ile
  SITE (166)..(166): Xaa at position 166 is Leu, Ala, Val, Gly, or Ile
  SITE (167)..(167): Xaa at position 167 is Leu, Ala, Val, Gly, or Ile
  SITE (181)..(181): Xaa at position 181 is Phe, Tyr, Met, His, Ile, Leu, Val Ala, or Gly
  SITE (192)..(192): Xaa at position 192 is Trp, Tyr, Phe, Met, His, Ile, Leu Val, Ala, or Gly
  SITE (196)..(196): Xaa at position 196 is Leu, Ala, Val, Gly, or Ile
  SITE (202)..(202): Xaa at position 202 is Val, Ala, Gly, Leu, or Ile
  SITE (204)..(204): Xaa at position 204 is Ile, Ala, Val, Leu, or Gly
IRSENITNNAKIXIXQXNESXIXNCTRPYNNTRRSTHVGPGQALFTTEIIGDXRQAHXNXSGTSWNKTXQQXTXKXKNLFNKTXXFKSPSGGDPEITTXSFNCGGEFXYXNTTNXXNNRETVNNRTXTXPXRIKQXXNMWQGXGKXXYAPPIAGRINCSSNXTGXXXTRDGGNGSQQNETXRPGGGDMRDNXRSEXYKYKVXKXEPLG

SEQ ID NO: 751 - protein, 1287 aa, Homo sapiens
  SITE (737)..(737): Xaa at position 737 is Val, Ala, Gly, Leu, or Ile
  SITE (739)..(739): Xaa at position 739 is Val, Ala, Gly, Leu, or Ile
  SITE (741)..(741): Xaa at position 741 is Trp, Tyr, Phe, Met, His, Ile, Leu Val, Ala, or Gly
  SITE (754)..(754): Xaa at position 754 is Phe, Tyr, Met, His, Ile, Leu, Val Ala, or Gly
  SITE (756)..(756): Xaa at position 756 is Val, Ala, Gly, Leu, or Ile
  SITE (782)..(782): Xaa at position 782 is Val, Ala, Gly, Leu, or Ile
  SITE (791)..(791): Xaa at position 791 is Tyr, Phe, Met, His, Ile, Leu, Val Ala, or Gly
  SITE (793)..(793): Xaa at position 793 is Phe, Tyr, Met, His, Ile, Leu, Val Ala, or Gly
  SITE (795)..(795): Xaa at position 795 is Val, Ala, Gly, Leu, or Ile
  SITE (797)..(797): Xaa at position 797 is Ala, Gly, or Pro
  SITE (815)..(815): Xaa at position 815 is Val, Ala, Gly, Leu, or Ile
  SITE (832)..(832): Xaa at position 832 is Ile, Ala, Val, Leu, or Gly
  SITE (843)..(843): Xaa at position 843 is Ile, Ala, Val, Leu, or Gly
  SITE (845)..(845): Xaa at position 845 is Leu, Ala, Val, Gly, or Ile
  SITE (862)..(862): Xaa at position 862 is Phe, Tyr, Met, His, Ile, Leu, Val Ala, or Gly
  SITE (864)..(864): Xaa at position 864 is Ile, Ala, Val, Leu, or Gly
  SITE (891)..(891): Xaa at position 891 is Ile, Ala, Val, Leu, or Gly
  SITE (900)..(900): Xaa at position 900 is Tyr, Phe, Met, His, Ile, Leu, Val Ala, or Gly
  SITE (902)..(902): Xaa at position 902 is Ile, Ala, Val, Leu, or Gly
  SITE (904)..(904): Xaa at position 904 is Met, Ile, Leu, Val, Ala, or Gly
  SITE (906)..(906): Xaa at position 906 is Cys, Ala, Val, Gly, Ser, or Thr
MHPDLGPLCTLLYVTLTILCSSVSSDLAPYFTSEPLSAVQKLGGPVVLHCSAQPVTTRISWLHNGKTLDGNLEHVKIHQGTLTILSLNSSLLGYYQCLANNSIGAIVSGPATVSVAVLGDFGSSTKHVITAEEKSAGFIGCRVPESNPKAEVRYKIRGKWLEHSTENYLILPSGNLQILNVSLEDKGSYKCAAYNPVTHQLKVEPIGRKLLVSRPSSDDVHILHPTHSQALAVLSRSPVTLECVVSGVPAPQVYWLKDGQDIAPGSNWRRLYSHLATDSVDPADSGNYSCMAGNKSGDVKYVTYMVNVLEHASISKGLQDQIVSLGATVHFTCDVHGNPAPNCTWFHNAQPIHPSARHLTAGNGLKISGVTVEDVGMYQCVADNGIGFMHSTGRLEIENDGGFKPVIITAPVSAKVADGDFVTLSCNASGLPVPVIRWYDSHGLITSHPSQVLRSKSRKSQLSRPEGLNLEPVYFVLSQAGASSLHIQAVTQEHAGKYICEAANEHGTTQAEASLMVVPFETNTKAETVTLPDAAQNDDRSKRDGSETGLLSSFPVKVHPSAVESAPEKNASGISVPDAPIILSPPQTHTPDTYNLVWRAGKDGGLPINAYFVKYRKLDDGVGMLGSWHTVRVPGSENELHLAELEPSSLYEVLMVARSAAGEGQPAMLTFRTSKEKTASSKNTQASSPPVGIPKYPVVSEAANNNFGVVLTDSSRHSGVPEAPDRPTISTASETSXYXTXIPRANGGSPITAXKXEYKRMRTSNWLVAAEDIPPSKLSVEXRSLEPGSTXKXRXIXINHYGESFRSSASRPYQXVGFPNRFSSRPITGPHXAYTEAVSDTQXMXKWTYIPSSNNNTPIQGXYXYYRPTDSDNDSDYKRDVVEGSKQWHMXGHLQPETSXDXKXQXFNEGGESEFSNVMICETKVKRVPGASEYPVKDLSTPPNSLGSGGNVGPATSPARSSDMLYLIVGCVLGVMVLILMVFIAMCLWKNRQQNTIQKYDPPGYLYQGSDMNGQMVDYTTLSGASQINGNVHGGFLTNGGLSSGYSHLHHKVPNAVNGIVNGSLNGGLYSGHSNSLTRTHVDFEHPHHLVNGGGMYTAVPQIDPLECVNCRNCRNNNRCFTKTNSTFSSSPPPVVPVVAPYPQDGLEMKPLSHVKVPVCLTSAVPDCGQLPEESVKDNVEPVPTQRTCCQDIVNDVSSDGSEDPAEFSRGQEGMINLRIPDHLQLAKSCVWEGDSCAHSETEINIVSWNALILPPVPEGCAEKTMWSPPGIPLDSPTEVLQQPRET

SEQ ID NO: 752 - protein, 1204 aa, Homo sapiens
  SITE (187)..(187): Xaa at position 187 is Val, Ala, Gly, Leu, or Ile
  SITE (189)..(189): Xaa at position 189 is Ile, Ala, Val, Leu, or Gly
  SITE (207)..(207): Xaa at position 207 is Leu, Ala, Val, Gly, or Ile
  SITE (210)..(210): Xaa at position 210 is Leu, Ala, Val, Gly, or Ile
  SITE (214)..(214): Xaa at position 214 is Ile, Ala, Val, Leu, or Gly
  SITE (215)..(215): Xaa at position 215 is Cys, Ala, Val, Gly, Ser, or Thr
  SITE (227)..(227): Xaa at position 227 is Leu, Ala, Val, Gly, or Ile
  SITE (228)..(228): Xaa at position 228 is Leu, Ala, Val, Gly, or Ile
  SITE (251)..(251): Xaa at position 251 is Leu, Ala, Val, Gly, or Ile
  SITE (253)..(253): Xaa at position 253 is Ala, Gly, or Pro
MCGRAAEAAASSRTPGREMGQAVTRRLGAGARAAPRRAMDGRTPRPQDAPARRKPKAKAPLPPAETKYTDVSSAADSVESTAFIMEQKENMIDKDVELSVVLPGDIIKSTTVHGSKPMMDLLIFLCAQYHLNPSSYTIDLLSAEQNHIKFKPNTPIGMLEVEKVILKPKMLDKKKPTPIIPEKTVRXVXNFKKTQKTIVRVSPHASXQEXAPIXXSKCEFDPLHTLXXKDYQSQEPLDLTKSLNDLGLREXYXMDVNRESCQISQNLDIMKEKENKGFFSFFQRSKKKRDQTASAPATPLVNKHRPTFTRSNTISKPYISNTLPSDAPKKRRAPLPPMPASQSVPQDLAHIQERPASCIVKSMSVDETDKSPCEAGRVRAGSLQLSSMSAGNSSLRRTKRKAPSPPSKIPPHQSDENSRVTALQPVDGVPPDSASEANSPEELSSPETFHPGLSSQEQCTAPKLMEETSVFECPGTPEAAITSLTSGISSDYSLEEIDEKEELSEVPKVEAENISPKSQDIPFVSTDIINTLKNDPDSALGNGSGEFSQNSMEEKQETKSTDGQEPHSVVYDTSNGKKVVDSIRNLKSLGPNQENVQNEIIVYPENTEDNMKNGVKKTEINVEGVAKNNNIDMEVERPSNSEAHETDTAISYKENHLAASSVPDQKLNQPSAEKTKDAAIQTTPSCNSFDGKHQDHNLSDSKVEECVQTSNNNISTQHSCLSSQDSVNTSREFRSQGTLIIHSEDPLTVKDPICAHGNDDLLPPVDRIDKNSTASYLKNYPLYRQDYNPKPKPSNEITREYIPKIGMTTYKIVPPKSLEISKDWQSETIEYKDDQDMHALGKKHTHENVKETAIQTEDSAISESPEEPLPNLKPKPNLRTEHQVPSSVSSPDDAMVSPLKPAPKMTRDTGTAPFAPNLEEINNILESKFKSRASNAQAKPSSFFLQMQKRVSGHYVTSAAAKSVHAAPNPAPKELTNKEAERDMLPSPEQTLSPLSKMPHSVPQPLVEKTDDDVIGQAPAEASPPPIAPKPVTIPASQVSTQNLKTLKTFGAPRPYSSSGPSPFALAVVKRSQSFSKERTESPSASALVQPPANTEEGKTHSVNKFVDIPQLGVSDKENNSAHNEQNSQIPTPTDGPSFTVMRQSSLTFQSSDPEQMRQSLLTAIRSGEAAAKLKRVTIPSNTISVNGRSRLSHSMSPDAQDGH

SEQ ID NO: 753 - protein, 1081 aa, Homo sapiens
  SITE (611)..(611): Xaa at position 611 is Ile, Ala, Val, Leu, or Gly
  SITE (613)..(613): Xaa at position 613 is Val, Ala, Gly, Leu, or Ile
  SITE (615)..(615): Xaa at position 615 is Ile, Ala, Val, Leu, or Gly
  SITE (634)..(634): Xaa at position 634 is Ala, Gly, or Pro
  SITE (637)..(637): Xaa at position 637 is Met, Ile, Leu, Val, Ala, or Gly
  SITE (640)..(640): Xaa at position 640 is Val, Ala, Gly, Leu, or Ile
  SITE (645)..(645): Xaa at position 645 is Val, Ala, Gly, Leu, or Ile
  SITE (646)..(646): Xaa at position 646 is Cys, Ala, Val, Gly, Ser, or Thr
  SITE (651)..(651): Xaa at position 651 is Ile, Ala, Val, Leu, or Gly
  SITE (659)..(659): Xaa at position 659 is Leu, Ala, Val, Gly, or Ile
  SITE (660)..(660): Xaa at position 660 is Ile, Ala, Val, Leu, or Gly
  SITE (669)..(669): Xaa at position 669 is Leu, Ala, Val, Gly, or Ile
  SITE (673)..(673): Xaa at position 673 is Val, Ala, Gly, Leu, or Ile
  SITE (685)..(685): Xaa at position 685 is Leu, Ala, Val, Gly, or Ile
  SITE (686)..(686): Xaa at position 686 is Leu, Ala, Val, Gly, or Ile
  SITE (688)..(688): Xaa at position 688 is Trp, Tyr, Phe, Met, His, Ile, Leu Val, Ala, or Gly
  SITE (689)..(689): Xaa at position 689 is Cys, Ala, Val, Gly, Ser, or Thr
  SITE (692)..(692): Xaa at position 692 is Ile, Ala, Val, Leu, or Gly
  SITE (693)..(693): Xaa at position 693 is Ala, Gly, or Pro
  SITE (699)..(699): Xaa at position 699 is Leu, Ala, Val, Gly, or Ile
  SITE (705)..(705): Xaa at position 705 is Val, Ala, Gly, Leu, or Ile
  SITE (706)..(706): Xaa at position 706 is His, Phe, Tyr, Lys, Arg, Gly, Ser Thr, Ala, Val, Leu, Ile, Asn, Met, or Gln
  SITE (709)..(709): Xaa at position 709 is Leu, Ala, Val, Gly, or Ile
  SITE (710)..(710): Xaa at position 710 is Ala, Gly, or Pro
  SITE (711)..(711): Xaa at position 711 is Ala, Gly, or Pro
  SITE (714)..(714): Xaa at position 714 is Val, Ala, Gly, Leu, or Ile
  SITE (716)..(716): Xaa at position 716 is Val, Ala, Gly, Leu, or Ile
  SITE (722)..(722): Xaa at position 722 is Val, Ala, Gly, Leu, or Ile
  SITE (724)..(724): Xaa at position 724 is Ile, Ala, Val, Leu, or Gly
  SITE (727)..(727): Xaa at position 727 is Phe, Tyr, Met, His, Ile, Leu, Val Ala, or Gly
  SITE (753)..(753): Xaa at position 753 is Ala, Gly, or Pro
  SITE (768)..(768): Xaa at position 768 is Val, Ala, Gly, Leu, or Ile
  SITE (771)..(771): Xaa at position 771 is Tyr, Phe, Met, His, Ile, Leu, Val Ala, or Gly
  SITE (773)..(773): Xaa at position 773 is Val, Ala, Gly, Leu, or Ile
  SITE (775)..(775): Xaa at position 775 is Val, Ala, Gly, Leu, or Ile
  SITE (778)..(778): Xaa at position 778 is Leu, Ala, Val, Gly, or Ile
  SITE (794)..(794): Xaa at position 794 is Ile, Ala, Val, Leu, or Gly
  SITE (798)..(798): Xaa at position 798 is Leu, Ala, Val, Gly, or Ile
  SITE (804)..(804): Xaa at position 804 is Leu, Ala, Val, Gly, or Ile
  SITE (814)..(814): Xaa at position 814 is Val, Ala, Gly, Leu, or Ile
  SITE (818)..(818): Xaa at position 818 is Met, Ile, Leu, Val, Ala, or Gly
  SITE (821)..(821): Xaa at position 821 is Cys, Ala, Val, Gly, Ser, or Thr
  SITE (822)..(822): Xaa at position 822 is Trp, Tyr, Phe, Met, His, Ile, Leu Val, Ala, or Gly
  SITE (832)..(832): Xaa at position 832 is Phe, Tyr, Met, His, Ile, Leu, Val Ala, or Gly
  SITE (835)..(835): Xaa at position 835 is Leu, Ala, Val, Gly, or Ile
  SITE (839)..(839): Xaa at position 839 is Phe, Tyr, Met, His, Ile, Leu, Val Ala, or Gly
  SITE (842)..(842): Xaa at position 842 is Met, Ile, Leu, Val, Ala, or Gly
  SITE (850)..(850): Xaa at position 850 is Leu, Ala, Val, Gly, or Ile
NRTEGAAHEKFTGNPAWRRAVQQQPCPVHVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPKDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFMRRRHIVRKRTLRRLLQERELVEPLTPSGEAPNQALLRILKETEFKKIKVLGSGAFGTVYKGLWIPEGEKVKXPXAXKELREATSPKANKEILDEXYVXASXDNPHXXRLLGXCLTSTVQXXTQLMPFGCXLDYXREHKDNIGSQYXXNXXVQXXKGMNYXEDRRLXXRDXXXRNXLXKTPQHXKXTDXGLAKLLGAEEKEYHAEGGKVPIKWMXLESILHRIYTHQSDXWSXGXTXWEXMTFGSKPYDGIPASEXSSIXEKGERXPQPPICTIDXYMIXVKXXMIDADSRPKXREXIIEXSKXARDPQRYXVIQGDERMHLPSPTDSNFYRALMDEEDMDDVVDADEYLIPQQGFFSSPSTSRTPLLSSLSATSNNSTVACIDRNGLQSCPIKEDSFLQRYSSDPTGALTEDSIDDTFLPVPEYINQSVPKRPAGSVQNPVYHNQPLNPAPSRDPHYQDPHSTAVGNPEYLNTVQPTCVNSTFDSPAHWAQKGSHQISLDNPDYQQDFFPKEAKPNGIFKGSTAENAEYLRVAPQSSEFIGA

SEQ ID NO: 754 - protein, 475 aa, Homo sapiens
  SITE (81)..(81): Xaa at position 81 is Cys, Ala, Val, Gly, Ser, or Thr
  SITE (88)..(88): Xaa at position 88 is Cys, Ala, Val, Gly, Ser, or Thr
  SITE (91)..(91): Xaa at position 91 is Cys, Ala, Val, Gly, Ser, or Thr
  SITE (107)..(107): Xaa at position 107 is Cys, Ala, Val, Gly, Ser, or Thr
  SITE (113)..(113): Xaa at position 113 is Leu, Ala, Val, Gly, or Ile
EEQEVSGLYDPRLQLRFLDVTQGRLVAKPPRPARSTAEDSSTPRDMLGLRPPLLALVGLLSLGCVLSQECTKFKVSSCREXIESGPGXTWXQKLNFTGPGDPDSIRXDTRPQXLMRGCAADDIMDPTSLAETQEDHNGGQKQLSPQKVTLYLRPGQAAAFNVTFRRAKGYPIDLYYLMDLSYSMLDDLRNVKKLGGDLLRALNEITESGRIGFGSFVDKTVLPFVNTHPDKLRNPCPNKEKECQPPFAFRHVLKLTNNSNQFQTEVGKQLISGNLDAPEGGLDAMMQVAACPEEIGWRNVTRLLVFATDDGFHFAGDGKLGAILTPNDGRCHLEDNLYKRSNEFDYPSVGQLAHKLAENNIQPIFAVTSRMVKTYEKLTEIIPKSAVGELSEDSSNVVHLIKNAYNVSLPHHSAGTHGVASNLPTAGQLLLQVSRRVVWEESPCPVGQLQPPDLPSGLQDTLARHFHGELWVLSR

SEQ ID NO: 755 - protein, 2391 aa, Homo sapiens
  SITE (33)..(33): Xaa at position 33 is Leu, Ala, Val, Gly, or Ile
MTDLLRSVVTVIDVFYKYTKQDGECGTLSKGEXKELLEKELHPVLKNPDDPDTVDVIMHMLDRDHDRRLDFTEFLLMIFKLTMACNKVLSKEYCKASGSKKHRRGHRHQEEESETEEDEEDTPGHKSGYRHSSWSEGEEHGYSSGHSRGTVKCRHGSNSRRLGRQGNLSSSGNQEGSQKRYHRSSCGHSWSGGKDRHGSSSVELRERINKSHISPSRESGEEYESGSGSNSWERKGHGGLSCGLETSGHESNSTQSRIREQKLGSSCSGSGDSGRRSHACGYSNSSGCGRPQNASSSCQSHRFGGQGNQFSYIQSGCQSGIKGGQGHGCVSGGQPSGCGQPESNPCSQSYSQRGYGARENGQPQNCGGQWRTGSSQSSCCGQYGSGGSQSCSNGQHEYGSCGRFSNSSSSNEFSKCDQYGSGSSQSTSFEQHGTGLSQSSGFEQHVCGSGQTCGQHESTSSQSLGYDQHGSSSGKTSGFGQHGSGSGQSSGFGQCGSGSGQSSGFGQHGSVSGQSSGFGQHGSVSGQSSGFGQHESRSRQSSYGQHGSGSSQSSGYGQYGSRETSGFGQHGLGSGQSTGFGQYGSGSGQSSGFGQHGSGSGQSSGFGQHESRSGQSSYGQHSSGSSQSSGYGQHGSRQTSGFGQHGSGSSQSTGFGQYGSGSGQSSGFGQHVSGSGQSSGFGQHESRSGHSSYGQHGFGSSQSSGYGQHGSSSGQTSGFGQHELSSGQSSSFGQHGSGSGQSSGFGQHGSGSGQSSGFGQHESRSGQSSYGQHSSGSSQSSGYGQHGSRQTSGFGQHGSGSSQSTGFGQYGSGSGQSAGFGQHGSGSGQSSGFGQHESRSHQSSYGQHGSGSSQSSGYGQHGSSSGQTSGFGQHRSSSGQYSGFGQHGSGSGQSSGFGQHGTGSGQYSGFGQHESRSHQSSYGQHGSGSSQSSGYGQHGSSSGQTFGFGQHRSGSGQSSGFGQHGSGSGQSSGFGQHESGSGKSSGFGQHESRSSQSNYGQHGSGSSQSSGYGQHGSSSGQTTGFGQHRSSSGQYSGFGQHGSGSDQSSGFGQHGTGSGQSSGFGQYESRSRQSSYGQHGSGSSQSSGYGQHGSNSGQTSGFGQHRPGSGQSSGFGQYGSGSGQSSGFGQHGSGTGKSSGFAQHEYRSGQSSYGQHGTGSSQSSGCGQHESGSGPTTSFGQHVSGSDNFSSSGQHISDSGQSTGFGQYGSGSGQSTGLGQGESQQVESGSTVHGRQETTHGQTINTTRHSQSGQGQSTQTGSRVTRRRRSSQSENSDSEVHSKVSHRHSEHIHTQAGSHYPKSGSTVRRRQGTTHGQRGDTTRHGHSGHGQSTQTGSRTSGRQRFSHSDATDSEVHSGVSHRPHSQEQTHSQAGSQHGESESTVHERHETTYGQTGEATGHGHSGHGQSTQRGSRTTGRRGSGHSESSDSEVHSGGSHRPQSQEQTHGQAGSQHGESGSTVHGRHGTTHGQTGDTTRHAHYHHGKSTQRGSSTTGRRGSGHSESSDSEVHSGGSHTHSGHTHGQSGSQHGESESIIHDRHRITHGQTGDTTRHSYSGHEQTTQTGSRTTGRQRTSHSESTDSEVHSGGSHRPHSREHTYGQAGSQHEEPEFTVHERHGTTHGQIGDTTGHSHSGHGQSTQRGSRTTGRQRSSHSESSDSEVHSGVSHTHTGHTHGQAGSQHGQSESIVPERHGTTHGQTGDTTRHAHYHHGLTTQTGSRTTGRRGSGHSEYSDSEGYSGVSHTHSGHTHGQARSQHGESESIVHERHGTIHGQTGDTTRHAHSGHGQSTQTGSRTTGRRSSGHSEYSDSEGHSGFSQRPHSRGHTHGQAGSQHGESESIVDERHGTTHGQTGDTSGHSQSGHGQSTQSGSSTTGRRRSGHSESSDSEVHSGGSHTHSGHTHSQARSQHGESESTVHKRHQTTHGQTGDTTEHGHPSHGQTIQTGSRTTGRRGSGHSEYSDSEGPSGVSHTHSGHTHGQAGSHYPESGSSVHERHGTTHGQTADTTRHGHSGHGQSTQRGSRTTGRRASGHSEYSDSEGHSGVSHTHSGHAHGQAGSQHGESGSSVHERHGTTHGQTGDTTRHAHSGHGQSTQRGSRTAGRRGSGHSESSDSEVHSGVSHTHSGHTYGQARSQHGESGSAIHGRQGTIHGQTGDTTRHGQSGHGQSTQTGSRTTGRQRSSHSESSDSEVHSEASPTHSGHTHSQAGSRHGQSGSSGHGRQGTTHGQTGDTTRHAHYGYGQSTQRGSRTTGRRGSGHSESSDSEVHSWGSHTHSGHIQGQAGSQQRQPGSTVHGRLETTHGQTGDTTRHGHSGYGQSTQTGSRSSRASHFQSHSSERQRHGSSQVWKHGSYGPAEYDYGHTGYGPSGGSRKSISNSHLSWSTDSTANKQLSRH

SEQ ID NO: 756 - protein, 1037 aa, Homo sapiens
  SITE (686)..(686): Xaa at position 686 is Leu, Ala, Val, Gly, or Ile
  SITE (687)..(687): Xaa at position 687 is Leu, Ala, Val, Gly, or Ile
  SITE (688)..(688): Xaa at position 688 is Leu, Ala, Val, Gly, or Ile
  SITE (689)..(689): Xaa at position 689 is Leu, Ala, Val, Gly, or Ile
  SITE (699)..(699): Xaa at position 699 is Ile, Ala, Val, Leu, or Gly
  SITE (703)..(703): Xaa at position 703 is Met, Ile, Leu, Val, Ala, or Gly
  SITE (738)..(738): Xaa at position 738 is Ile, Ala, Val, Leu, or Gly
  SITE (742)..(742): Xaa at position 742 is Leu, Ala, Val, Gly, or Ile
  SITE (745)..(745): Xaa at position 745 is Ala, Gly, or Pro
  SITE (746)..(746): Xaa at position 746 is Ile, Ala, Val, Leu, or Gly
  SITE (749)..(749): Xaa at position 749 is Ile, Ala, Val, Leu, or Gly
  SITE (756)..(756): Xaa at position 756 is Leu, Ala, Val, Gly, or Ile
  SITE (774)..(774): Xaa at position 774 is Ile, Ala, Val, Leu, or Gly
  SITE (789)..(789): Xaa at position 789 is Phe, Tyr, Met, His, Ile, Leu, Val Ala, or Gly
  SITE (793)..(793): Xaa at position 793 is Ala, Gly, or Pro
  SITE (796)..(796): Xaa at position 796 is Leu, Ala, Val, Gly, or Ile
  SITE (802)..(802): Xaa at position 802 is Val, Ala, Gly, Leu, or Ile
  SITE (805)..(805): Xaa at position 805 is Cys, Ala, Val, Gly, Ser, or Thr
  SITE (817)..(817): Xaa at position 817 is Cys, Ala, Val, Gly, Ser, or Thr
  SITE (818)..(818): Xaa at position 818 is Ala, Gly, or Pro
  SITE (821)..(821): Xaa at position 821 is Phe, Tyr, Met, His, Ile, Leu, Val Ala, or Gly
  SITE (825)..(825): Xaa at position 825 is Ile, Ala, Val, Leu, or Gly
  SITE (828)..(828): Xaa at position 828 is Ile, Ala, Val, Leu, or Gly
  SITE (862)..(862): Xaa at position 862 is Phe, Tyr, Met, His, Ile, Leu, Val Ala, or Gly
  SITE (864)..(864): Xaa at position 864 is Met, Ile, Leu, Val, Ala, or Gly
  SITE (867)..(867): Xaa at position 867 is Val, Ala, Gly, Leu, or Ile
  SITE (886)..(886): Xaa at position 886 is Ala, Gly, or Pro
  SITE (887)..(887): Xaa at position 887 is Ile, Ala, Val, Leu, or Gly
  SITE (889)..(889): Xaa at position 889 is Phe, Tyr, Met, His, Ile, Leu, Val Ala, or Gly
  SITE (890)..(890): Xaa at position 890 is Val, Ala, Gly, Leu, or Ile
  SITE (891)..(891): Xaa at position 891 is Val, Ala, Gly, Leu, or Ile
  SITE (896)..(896): Xaa at position 896 is Tyr, Phe, Met, His, Ile, Leu, Val Ala, or Gly
  SITE (916)..(916): Xaa at position 916 is Phe, Tyr, Met, His, Ile, Leu, Val Ala, or Gly
  SITE (925)..(925): Xaa at position 925 is Leu, Ala, Val, Gly, or Ile
  SITE (930)..(930): Xaa at position 930 is Val, Ala, Gly, Leu, or Ile
  SITE (931)..(931): Xaa at position 931 is Ile, Ala, Val, Leu, or Gly
  SITE (932)..(932): Xaa at position 932 is Leu, Ala, Val, Gly, or Ile
  SITE (934)..(934): Xaa at position 934 is Leu, Ala, Val, Gly, or Ile
  SITE (939)..(939): Xaa at position 939 is Leu, Ala, Val, Gly, or Ile
  SITE (940)..(940): Xaa at position 940 is Leu, Ala, Val, Gly, or Ile
  SITE (944)..(944): Xaa at position 944 is Val, Ala, Gly, Leu, or Ile
  SITE (980)..(980): Xaa at position 980 is Ala, Gly, or Pro
  SITE (984)..(984): Xaa at position 984 is Ile, Ala, Val, Leu, or Gly
  SITE (988)..(988): Xaa at position 988 is Phe, Tyr, Met, His, Ile, Leu, Val Ala, or Gly
  SITE (994)..(994): Xaa at position 994 is Ala, Gly, or Pro
  SITE (1015)..(1015): Xaa at position 1015 is Ile, Ala, Val, Leu, or Gly
  SITE (1022)..(1022): Xaa at position 1022 is Cys, Ala, Val, Gly, Ser, or Thr
  SITE (1026)..(1026): Xaa at position 1026 is Ile, Ala, Val, Leu, or Gly
  SITE (1030)..(1030): Xaa at position 1030 is His, Phe, Tyr, Lys, Arg, Gly Ser, Thr, Ala, Val, Leu, Ile, Asn, Met, or Gln
MGVRNCLYGNNMSGQRDIPPEIGEQPEQPPLEAPGAAAPGAGPSPAEEMETEPPHNEPIPVENDGEACGPPEVSRPNFQVLNPAFREAGAHGSYSPPPEEAMPFEAEQPSLGGFWPTLEQPGFPSGVHAGLEAFGPALMEPGAFSGARPGLGGYSPPPEEAMPFEFDQPAQRGCSQLLLQVPDLAPGGPGAAGVPGAPPEEPQALRPAKAGSRGGYSPPPEETMPFELDGEGFGDDSPPPGLSRVIAQVDGSSQFAAVAASSAVRLTPAANAPPLWVPGAIGSPSQEAVRPPSNFTGSSPWMEISGPPFEIGSAPAGVDDTPVNMDSPPIALDGPPIKVSGAPDKRERAERPPVEEEAAEMEGAADAAEGGKVPSPGYGSPAAGAASADTAARAAPAAPADPDSGATPEDPDSGTAPADPDSGAFAADPDSGAAPAAPADPDSGAAPDAPADPDSGAAPDAPADPDAGAAPEAPAAPAAAETRAAHVAPAAPDAGAPTAPAASATRAAQVRRAASAAPASGARRKIHLRPPSPEIQAADPPTPRPTRASAWRGKSESSRGRRVYYDEGVASSDDDSSGDESDDGTSGCLRWFQHRRNRRRRKPQRNLLRNFLVQAFGGCFGRSESPQPKASRSLKVKKVPLAEKRRQMRKEALEKRAQKRAEKKRSKLIDKQLQDEKMGYMCTHRXXXXGAGESGKSTXVKQXRILHVNGFNGEGGEEDPQAARSNSDGEKATKVQDXKNNXKEXXETXVAAMSNXVPPVELANPENQFRVDYXLSVMNVPDFDFPPEXYEHXKAXWEDEGXRAXYERSNEYQLIDXXQYXLDKXDVXKQADYVPSDQDLLRCRVLTSGIFETKFQVDKVNXHXFDXGGQRDERRKWIQCFNDVTXXIXXXASSSXNMVIREDNQTNRLQEALNLXKSIWNNRWXRTISXXXFXNKQDXXAEKXLAGKSKIEDYFPEFARYTTPEDATPEPGEDPRVTRXKYFXRDEXLRISTXSGDGRHYCYPHFTCAVDTENXRRVFNDXRDIXQRMXLRQYELL

SEQ ID NO: 757 - protein, 576 aa, Homo sapiens
  SITE (73)..(73): Xaa at position 73 is Ala, Gly, or Pro
  SITE (96)..(96): Xaa at position 96 is Leu, Ala, Val, Gly, or Ile
  SITE (108)..(108): Xaa at position 108 is Leu, Ala, Val, Gly, or Ile
  SITE (164)..(164): Xaa at position 164 is Val, Ala, Gly, Leu, or Ile
  SITE (173)..(173): Xaa at position 173 is Ala, Gly, or Pro
  SITE (185)..(185): Xaa at position 185 is Leu, Ala, Val, Gly, or Ile
  SITE (188)..(188): Xaa at position 188 is Val, Ala, Gly, Leu, or Ile
  SITE (201)..(201): Xaa at position 201 is Ile, Ala, Val, Leu, or Gly
  SITE (212)..(212): Xaa at position 212 is Ile, Ala, Val, Leu, or Gly
  SITE (214)..(214): Xaa at position 214 is Phe, Tyr, Met, His, Ile, Leu, Val Ala, or Gly
MPALSTGSGSDTGLYELLAALPAQLQPHVDSQEDLTFLWDMFGEKSLHSLVKIHEKLHYYEKQSPVPILHGAXALADDLAEELQNKPLNSEIRELXKLLSKPNVKALXSVHDTVAQKNYDPVLPPMPEDIDDEEDSVKIIRLVKNREPLGATIKKDEQTGAIIXARIMRGGAXDRSGLIHVGDEXREXNGIPVEDKRPEEXIQILAQSQGAXTXKIIPGSKEETPSKEGKMFIKALFDYNPNEDKAIPCKEAGLSFKKGDILQIMSQDDATWWQAKHEADANPRAGLIPSKHFQERRLALRRPEILVQPLKVSNRKSSGFRKSFRLSRKDKKTNKSMYECKKSDQYDTADVPTYEEVTPYRRQTNEKYRLVVLVGPVGVGLNELKRKLLISDTQHYGVTVPHTTRARRSQESDGVEYIFISKHLFETDVQNNKFIEYGEYKNNYYGTSIDSVRSVLAKNKVCLLDVQPHTVKHLRTLEFKPYVIFIKPPSIERLRETRKNAKIISSRDDQGAAKPFTEEDFQEMIKSAQIMESQYGHLFDKIIINDDLTVAFNELKTTFDKLETETHWVPVSWLHS

SEQ ID NO: 758 - protein, 1072 aa, Homo sapiens
  SITE (354)..(354): Xaa at position 354 is Leu, Ala, Val, Gly, or Ile
  SITE (356)..(356): Xaa at position 356 is Ala, Gly, or Pro
  SITE (372)..(372): Xaa at position 372 is Trp, Tyr, Phe, Met, His, Ile, Leu Val, Ala, or Gly
  SITE (393)..(393): Xaa at position 393 is Leu, Ala, Val, Gly, or Ile
  SITE (395)..(395): Xaa at position 395 is Leu, Ala, Val, Gly, or Ile
  SITE (403)..(403): Xaa at position 403 is Tyr, Phe, Met, His, Ile, Leu, Val Ala, or Gly
  SITE (405)..(405): Xaa at position 405 is Phe, Tyr, Met, His, Ile, Leu, Val Ala, or Gly
  SITE (407)..(407): Xaa at position 407 is Val, Ala, Gly, Leu, or Ile
  SITE (409)..(409): Xaa at position 409 is Val, Ala, Gly, Leu, or Ile
  SITE (422)..(422): Xaa at position 422 is Val, Ala, Gly, Leu, or Ile
  SITE (424)..(424): Xaa at position 424 is Val, Ala, Gly, Leu, or Ile
  SITE (629)..(629): Xaa at position 629 is Ala, Gly, or Pro
  SITE (644)..(644): Xaa at position 644 is Leu, Ala, Val, Gly, or Ile
  SITE (660)..(660): Xaa at position 660 is Trp, Tyr, Phe, Met, His, Ile, Leu Val, Ala, or Gly
  SITE (679)..(679): Xaa at position 679 is Ala, Gly, or Pro
  SITE (681)..(681): Xaa at position 681 is Val, Ala, Gly, Leu, or Ile
  SITE (684)..(684): Xaa at position 684 is Leu, Ala, Val, Gly, or Ile
  SITE (691)..(691): Xaa at position 691 is Phe, Tyr, Met, His, Ile, Leu, Val Ala, or Gly
  SITE (693)..(693): Xaa at position 693 is Leu, Ala, Val, Gly, or Ile
  SITE (695)..(695): Xaa at position 695 is Val, Ala, Gly, Leu, or Ile
  SITE (709)..(709): Xaa at position 709 is Val, Ala, Gly, Leu, or Ile
MAPPTGVLSSLLLLVTIAGCARKQCSEGRTYSNAVISPNLETTRIMRVSHTFPVVDCTAACCDLSSCDLAWWFEGRCYLVSCPHKENCEPKKMGPIRSYLTFVLRPVQRPAQLLDYGDMMLNRGSPSGIWGDSPEDIRKDLTFLGKDWGLEEMSEYSDDYRELEKDLLQPSGKQEPRGSAEYTDWGLLPGSEGAFNSSVGDSPAVPAETQQDPELHYLNESASTPAPKLPERSVLLPLPTTPSSGEVLEKEKASQLQEQSSNSSGKEVLMPSHSLPPASLELSSVTVEKSPVLTVTPGSTEHSIPTPPTSAAPSESTPSELPISPTTAPRTVKELTVSAGDNLIITLPDNEVEXKXFVAPAPPVETTYNYEXNLISHPTDYQGEIKQGHKQTXNXSQLSVGLXVXKXTXSSENAFGEGFVNXTXKPARRVNLPPVAVVSPQLQELTLPLTSALIDGSQSTDDTEIVSYHWEEINGPFIEEKTSVDSPVLRLSNLDPGNYSFRLTVTDSDGATNSTTAALIVNNAVDYPPVANAGPNHTITLPQNSITLNGNQSSDDHQIVLYEWSLGPGSEGKHVVMQGVQTPYLHLSAMQEGDYTFQLKVTDSSRQQSTAVVTVIVQPENNRPPVAVXGPDKELIFPVESATXDGSSSSDDHGIVFYHXEHVRGPSAVEMENIDKAIXTXTGXQVGTYHXRXTXKDQQGLSSTSTLTXAVKKENNSPPRARAGGRHVLVLPNNSITLDGSRSTDDQRIVSYLWIRDGQSPAAGDVIDGSDHSVALQLTNLVEGVYTFHLRVTDSQGASDTDTATVEVQPDPRKSGLVELTLQVGVGQLTEQRKDTLVRQLAVLLNVLDSDIKVQKIRAHSDLSTVIVFYVQSRPPFKVLKAAEVARNLHMRLSKEKADFLLFKVLRVDTAGCLLKCSGHGHCDPLTKRCICSHLWMENLIQRYIWDGESNCEWSIFYVTVLAFTLIVLTGGFTWLCICCCKRQKRTKIRKKTKYTILDNMDEQERMELRPKYGIKHRSTEHNSSLMVSESEFDSDQDTIFSREKMERGNPKVSMNGSIRNGASFSYCSKDR

SEQ ID NO: 759 - protein, 1189 aa, Homo sapiens
  SITE (653)..(653): Xaa at position 653 is Leu, Ala, Val, Gly, or Ile
MSAGGSARKSTGRSSYYYRLLRRPRLQRQRSRSRSRTRPARESPQERPGSRRSLPGSLSEKSPSMEPSAATPFRVTGFLSRRLKGSIKRTKSQPKLDRNHSFRHILPGFRSAAAAAADNERSHLMPRLKESRSHESLLSPSSAVEALDLSMEEEVVIKPVHSSILGQDYCFEVTTSSGSKCFSCRSAAERDKWMENLRRAVHPNKDNSRRVEHILKLWVIEAKDLPAKKKYLCELCLDDVLYARTTGKLKTDNVFWGEHFEFHNLPPLRTVTVHLYRETDKKKKKERNSYLGLVSLPAASVAGRQFVEKWYPVVTPNPKGGKGPGPMIRIKARYQTITILPMEMYKEFAEHITNHYLGLCAALEPILSAKTKEEMASALVHILQSTGKVKDFLTDLMMSEVDRCGDNEHLIFRENTLATKAIEEYLKLVGQKYLQDALGEFIKALYESDENCEVDPSKCSAADLPEHQGNLKMCCELAFCKIINSYCVFPRELKEVFASWRQECSSRGRPDISERLISASLFLRFLCPAIMSPSLFNLLQEYPDDRTARTLTLIAKVTQNLANFAKFGSKEEYMSFMNQFLEHEWTNMQRFLLEISNPETLSNTAGFEGYIDLGRELSSLHSLLWEAVSQLEQSIVSKLGPLPRILRDVHTAXSTPGSGQLPGTNDLASTPGSGSSSISAGLQKMVIENDLSGLIDFTRLPSPTPENKDLFFVTRSSGVQPSPARSSSYSEANEPDLQMANGGKSLSMVDLQDARTLDGEAGSPAGPDVLPTDGQAAAAQLVAGWPARATPVNLAGLATVRRAGQTPTTPGTSEGAPGRPQLLAPLSFQNPVYQMAAGLPLSPRGLGDSGSEGHSSLSSHSNSEELAAAAKLGSFSTAAEELARRPGELARRQMSLTEKGGQPTVPRQNSAGPQRRIDQPPPPPPPPPPAPRGRTPPNLLSTLQYPRPSSGTLASASPDWVGPSTRLRQQSSSSKGDSPELKPRAVHKQGPSPVSPNALDRTAAWLLTMNAQLLEDEGLGPDPPHRDRLRSKDELSQAEKDLAVLQDKLRISTKKLEEYETLFKCQEETTQKLVLEYQARLEEGEERLRRQQEDKDIQMKGIISRLMSVEEELKKDHAEMQAAVDSKQKIIDAQEKRIASLDAANARLMSALTQLKERYSMQARNGISPTNPTKLQITENGEFRNSSNC

SEQ ID NO: 760 - protein, 342 aa, Homo sapiens
  SITE (5)..(5): Xaa at position 5 is Leu, Ala, Val, Gly, or Ile
  SITE (6)..(6): Xaa at position 6 is Ile, Ala, Val, Leu, or Gly
  SITE (9)..(9): Xaa at position 9 is Ala, Gly, or Pro
  SITE (15)..(15): Xaa at position 15 is Leu, Ala, Val, Gly, or Ile
  SITE (16)..(16): Xaa at position 16 is Cys, Ala, Val, Gly, Ser, or Thr
  SITE (17)..(17): Xaa at position 17 is Ala, Gly, or Pro
  SITE (31)..(31): Xaa at position 31 is Ala, Gly, or Pro
  SITE (32)..(32): Xaa at position 32 is Val, Ala, Gly, Leu, or Ile
  SITE (33)..(33): Xaa at position 33 is Trp, Tyr, Phe, Met, His, Ile, Leu Val, Ala, or Gly
  SITE (56)..(56): Xaa at position 56 is Ala, Gly, or Pro
  SITE (58)..(58): Xaa at position 58 is Leu, Ala, Val, Gly, or Ile
  SITE (80)..(80): Xaa at position 80 is Leu, Ala, Val, Gly, or Ile
  SITE (106)..(106): Xaa at position 106 is Val, Ala, Gly, Leu, or Ile
  SITE (107)..(107): Xaa at position 107 is Ala, Gly, or Pro
  SITE (111)..(111): Xaa at position 111 is Ile, Ala, Val, Leu, or Gly
  SITE (114)..(114): Xaa at position 114 is Ile, Ala, Val, Leu, or Gly
  SITE (115)..(115): Xaa at position 115 is Ile, Ala, Val, Leu, or Gly
  SITE (135)..(135): Xaa at position 135 is Ile, Ala, Val, Leu, or Gly
  SITE (142)..(142): Xaa at position 142 is Trp, Tyr, Phe, Met, His, Ile, Leu Val, Ala, or Gly
  SITE (144)..(144): Xaa at position 144 is Val, Ala, Gly, Leu, or Ile
  SITE (154)..(154): Xaa at position 154 is Phe, Tyr, Met, His, Ile, Leu, Val Ala, or Gly
  SITE (157)..(157): Xaa at position 157 is Ile, Ala, Val, Leu, or Gly
  SITE (158)..(158): Xaa at position 158 is Val, Ala, Gly, Leu, or Ile
  SITE (159)..(159): Xaa at position 159 is Leu, Ala, Val, Gly, or Ile
  SITE (163)..(163): Xaa at position 163 is Val, Ala, Gly, Leu, or Ile
  SITE (166)..(166): Xaa at position 166 is Ile, Ala, Val, Leu, or Gly
  SITE (173)..(173): Xaa at position 173 is Ile, Ala, Val, Leu, or Gly
  SITE (185)..(185): Xaa at position 185 is Leu, Ala, Val, Gly, or Ile
  SITE (194)..(194): Xaa at position 194 is Tyr, Phe, Met, His, Ile, Leu, Val Ala, or Gly
  SITE (195)..(195): Xaa at position 195 is Ala, Gly, or Pro
  SITE (198)..(198): Xaa at position 198 is Leu, Ala, Val, Gly, or Ile
  SITE (199)..(199): Xaa at position 199 is Phe, Tyr, Met, His, Ile, Leu, Val Ala, or Gly
  SITE (221)..(221): Xaa at position 221 is Ile, Ala, Val, Leu, or Gly
  SITE (224)..(224): Xaa at position 224 is Val, Ala, Gly, Leu, or Ile
  SITE (243)..(243): Xaa at position 243 is Val, Ala, Gly, Leu, or Ile
  SITE (262)..(262): Xaa at position 262 is Val, Ala, Gly, Leu, or Ile
  SITE (266)..(266): Xaa at position 266 is Val, Ala, Gly, Leu, or Ile
  SITE (311)..(311): Xaa at position 311 is Phe, Tyr, Met, His, Ile, Leu, Val Ala, or Gly
  SITE (312)..(312): Xaa at position 312 is Leu, Ala, Val, Gly, or Ile
  SITE (313)..(313): Xaa at position 313 is Ala, Gly, or Pro
  SITE (314)..(314): Xaa at position 314 is Cys, Ala, Val, Gly, Ser, or Thr
  SITE (319)..(319): Xaa at position 319 is Phe, Tyr, Met, His, Ile, Leu, Val Ala, or Gly
  SITE (328)..(328): Xaa at position 328 is Ile, Ala, Val, Leu, or Gly
  SITE (331)..(331): Xaa at position 331 is Ala, Gly, or Pro
  SITE (334)..(334): Xaa at position 334 is Val, Ala, Gly, Leu, or Ile
MAQVXXVGXGMTGSXXXALLRRQTSGPLYLXXXDKAEDSGGRMTTACSPHNPQCTXDXGAQYITCTPHYAKKHQRFYDEXLAYGVLRPLSSPIEGMVMKEGDCNFXXPQGXSSXXKHYLKESGAEVYFRHRVTQXNLRDDKXEXSKQTGSPEQXDLXXXTMPXPEXLQLQGDXTTLISECQRQQXEAVSYSSRXXLGXXYEAGTKIDVPWAGQYITSNPCXRFXSIDNKKRNIESSEIGPSLXIHTTVPFGVTYLEHSIEDXQELXFQQLENILPGLPQPIATKCQKWRHSQVTNAAANCPGQMTLHHKPXXXXGGDGXTQSNFDGCXTSXLCXLEALKNYI

SEQ ID NO: 761 - protein, 562 aa, Influenza A virus
  strain A/Singapore/1/1957 H2N2
  SITE (7)..(7): Xaa at position 7 is Ile, Ala, Val, Leu, or Gly
  SITE (18)..(18): Xaa at position 18 is Ile, Ala, Val, Leu, or Gly
  SITE (19)..(19): Xaa at position 19 is Cys, Ala, Val, Gly, Ser, or Thr
  SITE (20)..(20): Xaa at position 20 is Ile, Ala, Val, Leu, or Gly
  SITE (22)..(22): Xaa at position 22 is Tyr, Phe, Met, His, Ile, Leu, Val Ala, or Gly
  SITE (24)..(24): Xaa at position 24 is Ala, Gly, or Pro
  SITE (31)..(31): Xaa at position 31 is Val, Ala, Gly, Leu, or Ile
  SITE (34)..(34): Xaa at position 34 is Ile, Ala, Val, Leu, or Gly
  SITE (41)..(41): Xaa at position 41 is Val, Ala, Gly, Leu, or Ile
  SITE (47)..(47): Xaa at position 47 is Ile, Ala, Val, Leu, or Gly
  SITE (48)..(48): Xaa at position 48 is Leu, Ala, Val, Gly, or Ile
  SITE (56)..(56): Xaa at position 56 is Leu, Ala, Val, Gly, or Ile
  SITE (57)..(57): Xaa at position 57 is Cys, Ala, Val, Gly, Ser, or Thr
  SITE (59)..(59): Xaa at position 59 is Leu, Ala, Val, Gly, or Ile
  SITE (65)..(65): Xaa at position 65 is Leu, Ala, Val, Gly, or Ile
  SITE (67)..(67): Xaa at position 67 is Leu, Ala, Val, Gly, or Ile
  SITE (70)..(70): Xaa at position 70 is Cys, Ala, Val, Gly, Ser, or Thr
  SITE (72)..(72): Xaa at position 72 is Ile, Ala, Val, Leu, or Gly
  SITE (73)..(73): Xaa at position 73 is Ala, Gly, or Pro
  SITE (75)..(75): Xaa at position 75 is Trp, Tyr, Phe, Met, His, Ile, Leu Val, Ala, or Gly
  SITE (76)..(76): Xaa at position 76 is Leu, Ala, Val, Gly, or Ile
  SITE (77)..(77): Xaa at position 77 is Leu, Ala, Val, Gly, or Ile
  SITE (82)..(82): Xaa at position 82 is Cys, Ala, Val, Gly, Ser, or Thr
  SITE (85)..(85): Xaa at position 85 is Leu, Ala, Val, Gly, or Ile
  SITE (91)..(91): Xaa at position 91 is Trp, Tyr, Phe, Met, His, Ile, Leu Val, Ala, or Gly
  SITE (93)..(93): Xaa at position 93 is Tyr, Phe, Met, His, Ile, Leu, Val Ala, or Gly
  SITE (94)..(94): Xaa at position 94 is Ile, Ala, Val, Leu, or Gly
  SITE (95)..(95): Xaa at position 95 is Met, Ile, Leu, Val, Ala, or Gly
  SITE (106)..(106): Xaa at position 106 is Tyr, Phe, Met, His, Ile, Leu, Val Ala, or Gly
  SITE (116)..(116): Xaa at position 116 is Leu, Ala, Val, Gly, or Ile
  SITE (119)..(119): Xaa at position 119 is Leu, Ala, Val, Gly, or Ile
  SITE (120)..(120): Xaa at position 120 is Leu, Ala, Val, Gly, or Ile
  SITE (123)..(123): Xaa at position 123 is Val, Ala, Gly, Leu, or Ile
  SITE (126)..(126): Xaa at position 126 is Phe, Tyr, Met, His, Ile, Leu, Val Ala, or Gly
  SITE (132)..(132): Xaa at position 132 is Leu, Ala, Val, Gly, or Ile
  SITE (148)..(148): Xaa at position 148 is Ala, Gly, or Pro
  SITE (149)..(149): Xaa at position 149 is Cys, Ala, Val, Gly, Ser, or Thr
  SITE (151)..(151): Xaa at position 151 is Val, Ala, Gly, Leu, or Ile
  SITE (161)..(161): Xaa at position 161 is Met, Ile, Leu, Val, Ala, or Gly
  SITE (162)..(162): Xaa at position 162 is Val, Ala, Gly, Leu, or Ile
  SITE (163)..(163): Xaa at position 163 is Trp, Tyr, Phe, Met, His, Ile, Leu Val, Ala, or Gly
  SITE (164)..(164): Xaa at position 164 is Leu, Ala, Val, Gly, or Ile
  SITE (174)..(174): Xaa at position 174 is Ala, Gly, or Pro
  SITE (186)..(186): Xaa at position 186 is Met, Ile, Leu, Val, Ala, or Gly
  SITE (187)..(187): Xaa at position 187 is Leu, Ala, Val, Gly, or Ile
  SITE (188)..(188): Xaa at position 188 is Ile, Ala, Val, Leu, or Gly
  SITE (189)..(189): Xaa at position 189 is Ile, Ala, Val, Leu, or Gly
  SITE (190)..(190): Xaa at position 190 is Trp, Tyr, Phe, Met, His, Ile, Leu Val, Ala, or Gly
  SITE (192)..(192): Xaa at position 192 is Val, Ala, Gly, Leu, or Ile
  SITE (193)..(193): Xaa at position 193 is His, Phe, Tyr, Lys, Arg, Gly, Ser Thr, Ala, Val, Leu, Ile, Asn, Met, or Gln
  SITE (194)..(194): Xaa at position 194 is His, Phe, Tyr, Lys, Arg, Gly, Ser Thr, Ala, Val, Leu, Ile, Asn, Met, or Gln
  SITE (205)..(205): Xaa at position 205 is Tyr, Phe, Met, His, Ile, Leu, Val Ala, or Gly
  SITE (211)..(211): Xaa at position 211 is Tyr, Phe, Met, His, Ile, Leu, Val Ala, or Gly
  SITE (212)..(212): Xaa at position 212 is Val, Ala, Gly, Leu, or Ile
  SITE (214)..(214): Xaa at position 214 is Val, Ala, Gly, Leu, or Ile
  SITE (219)..(219): Xaa at position 219 is Leu, Ala, Val, Gly, or Ile
  SITE (236)..(236): Xaa at position 236 is Leu, Ala, Val, Gly, or Ile
  SITE (240)..(240): Xaa at position 240 is Met, Ile, Leu, Val, Ala, or Gly
  SITE (242)..(242): Xaa at position 242 is Phe, Tyr, Met, His, Ile, Leu, Val Ala, or Gly
  SITE (246)..(246): Xaa at position 246 is Leu, Ala, Val, Gly, or Ile
  SITE (247)..(247): Xaa at position 247 is Leu, Ala, Val, Gly, or Ile
  SITE (253)..(253): Xaa at position 253 is Ile, Ala, Val, Leu, or Gly
  SITE (255)..(255): Xaa at position 255 is Phe, Tyr, Met, His, Ile, Leu, Val Ala, or Gly
  SITE (261)..(261): Xaa at position 261 is Leu, Ala, Val, Gly, or Ile
  SITE (262)..(262): Xaa at position 262 is Ile, Ala, Val, Leu, or Gly
  SITE (263)..(263): Xaa at position 263 is Ala, Gly, or Pro
  SITE (266)..(266): Xaa at position 266 is Tyr, Phe, Met, His, Ile, Leu, Val Ala, or Gly
  SITE (268)..(268): Xaa at position 268 is Phe, Tyr, Met, His, Ile, Leu, Val Ala, or Gly
  SITE (270)..(270): Xaa at position 270 is Ile, Ala, Val, Leu, or Gly
  SITE (278)..(278): Xaa at position 278 is Ile, Ala, Val, Leu, or Gly
  SITE (279)..(279): Xaa at position 279 is Met, Ile, Leu, Val, Ala, or Gly
  SITE (288)..(288): Xaa at position 288 is Cys, Ala, Val, Gly, Ser, or Thr
  SITE (292)..(292): Xaa at position 292 is Cys, Ala, Val, Gly, Ser, or Thr
  SITE (298)..(298): Xaa at position 298 is Ala, Gly, or Pro
  SITE (299)..(299): Xaa at position 299 is Ile, Ala, Val, Leu, or Gly
  SITE (306)..(306): Xaa at position 306 is His, Phe, Tyr, Lys, Arg, Gly, Ser Thr, Ala, Val, Leu, Ile, Asn, Met, or Gln
  SITE (309)..(309): Xaa at position 309 is His, Phe, Tyr, Lys, Arg, Gly, Ser Thr, Ala, Val, Leu, Ile, Asn, Met, or Gln
  SITE (313)..(313): Xaa at position 313 is Ile, Ala, Val, Leu, or Gly
  SITE (320)..(320): Xaa at position 320 is Val, Ala, Gly, Leu, or Ile
  SITE (325)..(325): Xaa at position 325 is Leu, Ala, Val, Gly, or Ile
  SITE (327)..(327): Xaa at position 327 is Leu, Ala, Val, Gly, or Ile
  SITE (328)..(328): Xaa at position 328 is Ala, Gly, or Pro
  SITE (331)..(331): Xaa at position 331 is Leu, Ala, Val, Gly, or Ile
  SITE (345)..(345): Xaa at position 345 is Ala, Gly, or Pro
  SITE (357)..(357): Xaa at position 357 is Met, Ile, Leu, Val, Ala, or Gly
  SITE (362)..(362): Xaa at position 362 is Tyr, Phe, Met, His, Ile, Leu, Val Ala, or Gly
  SITE (384)..(384): Xaa at position 384 is Ala, Gly, or Pro
  SITE (385)..(385): Xaa at position 385 is Phe, Tyr, Met, His, Ile, Leu, Val Ala, or Gly
  SITE (436)..(436): Xaa at position 436 is Ala, Gly, or Pro
  SITE (448)..(448): Xaa at position 448 is Leu, Ala, Val, Gly, or Ile
  SITE (451)..(451): Xaa at position 451 is His, Phe, Tyr, Lys, Arg, Gly, Ser Thr, Ala, Val, Leu, Ile, Asn, Met, or Gln
  SITE (455)..(455): Xaa at position 455 is Val, Ala, Gly, Leu, or Ile
  SITE (458)..(458): Xaa at position 458 is Leu, Ala, Val, Gly, or Ile
  SITE (462)..(462): Xaa at position 462 is Val, Ala, Gly, Leu, or Ile
  SITE (466)..(466): Xaa at position 466 is Leu, Ala, Val, Gly, or Ile
  SITE (477)..(477): Xaa at position 477 is Cys, Ala, Val, Gly, Ser, or Thr
  SITE (482)..(482): Xaa at position 482 is His, Phe, Tyr, Lys, Arg, Gly, Ser Thr, Ala, Val, Leu, Ile, Asn, Met, or Gln
  SITE (484)..(484): Xaa at position 484 is Cys, Ala, Val, Gly, Ser, or Thr
  SITE (488)..(488): Xaa at position 488 is Cys, Ala, Val, Gly, Ser, or Thr
  SITE (489)..(489): Xaa at position 489 is Met, Ile, Leu, Val, Ala, or Gly
MAIIYLXLLFTAVRGDQXXXGXHXNNSTEKXDTXLERNVTXTHAKDXXEKTHNGKXXKXNGIPPXEXGDXSXXGXXXGNPEXDRXLSVPEXSXXXEKENPRDGLCXPGSFNDYEEXKHXXSSXKHXEKVKIXPKDRWTQHTTTGGSRXXAXSGNPSFFRNXXXXTEKGSNYPVXKGSYNNTSGEQXXXXXGXXXPNDEKEQRTLXQNVGTXXSXGTSTXNKRSTPDIATRPKVNGXGSRXEXSWTXXDMWDTXNXESTGNXXXPEXGXKXSKRGSSGXXKTEGTLENXETKXQTPLGXXNTTLPFXNVXPLTXGECPKYXKSEKXVXXTGXRNVPQIESRGLFGXIAGFIEGGWQGXIDGWXGYHHSNDQGSGYAADKESTQKXXDGITNKVNSVIEKMNTQFEAVGKEFSNLERRLENLNKKMEDGFLDVWTYNXELLVLMENERTXDFXDSNXKNXYDKXRMQXRDNVKELGNGXFEFYXKXDDEXXNSVKNGTYDYPKYEEESKLNRNEIKGVKLSSMGVYQILAIYATVAGSLSLAIMMAGISFWMCSNGSLQCRICI

SEQ ID NO: 762 - protein, 873 aa, Human immunodeficiency virus 1
  SITE (52)..(52): Xaa at position 52 is Ala, Gly, or Pro
  SITE (63)..(63): Xaa at position 63 is His, Phe, Tyr, Lys, Arg, Gly, Ser Thr, Ala, Val, Leu, Ile, Asn, Met, or Gln
  SITE (67)..(67): Xaa at position 67 is Ala, Gly, or Pro
  SITE (92)..(92): Xaa at position 92 is Met, Ile, Leu, Val, Ala, or Gly
  SITE (97)..(97): Xaa at position 97 is Met, Ile, Leu, Val, Ala, or Gly
  SITE (98)..(98): Xaa at position 98 is Val, Ala, Gly, Leu, or Ile
  SITE (101)..(101): Xaa at position 101 is Met, Ile, Leu, Val, Ala, or Gly
  SITE (109)..(109): Xaa at position 109 is Trp, Tyr, Phe, Met, His, Ile, Leu Val, Ala, or Gly
  SITE (117)..(117): Xaa at position 117 is Val, Ala, Gly, Leu, or Ile
  SITE (124)..(124): Xaa at position 124 is Val, Ala, Gly, Leu, or Ile
  SITE (172)..(172): Xaa at position 172 is Ile, Ala, Val, Leu, or Gly
  SITE (239)..(239): Xaa at position 239 is Tyr, Phe, Met, His, Ile, Leu, Val Ala, or Gly
  SITE (240)..(240): Xaa at position 240 is Cys, Ala, Val, Gly, Ser, or Thr
  SITE (246)..(246): Xaa at position 246 is Ala, Gly, or Pro
  SITE (247)..(247): Xaa at position 247 is Ile, Ala, Val, Leu, or Gly
  SITE (250)..(250): Xaa at position 250 is Cys, Ala, Val, Gly, Ser, or Thr
  SITE (261)..(261): Xaa at position 261 is Cys, Ala, Val, Gly, Ser, or Thr
  SITE (264)..(264): Xaa at position 264 is Val, Ala, Gly, Leu, or Ile
  SITE (273)..(273): Xaa at position 273 is Ile, Ala, Val, Leu, or Gly
  SITE (281)..(281): Xaa at position 281 is Leu, Ala, Val, Gly, or Ile
  SITE (282)..(282): Xaa at position 282 is Leu, Ala, Val, Gly, or Ile
  SITE (292)..(292): Xaa at position 292 is Val, Ala, Gly, Leu, or Ile
  SITE (306)..(306): Xaa at position 306 is Ile, Ala, Val, Leu, or Gly
  SITE (307)..(307): Xaa at position 307 is Ile, Ala, Val, Leu, or Gly
  SITE (308)..(308): Xaa at position 308 is Ile, Ala, Val, Leu, or Gly
  SITE (310)..(310): Xaa at position 310 is Leu, Ala, Val, Gly, or Ile
  SITE (314)..(314): Xaa at position 314 is Val, Ala, Gly, Leu, or Ile
  SITE (316)..(316): Xaa at position 316 is Ile, Ala, Val, Leu, or Gly
  SITE (318)..(318): Xaa at position 318 is Cys, Ala, Val, Gly, Ser, or Thr
  SITE (346)..(346): Xaa at position 346 is Ile, Ala, Val, Leu, or Gly
  SITE (351)..(351): Xaa at position 351 is Cys, Ala, Val, Gly, Ser, or Thr
  SITE (353)..(353): Xaa at position 353 is Ile, Ala, Val, Leu, or Gly
  SITE (358)..(358): Xaa at position 358 is Trp, Tyr, Phe, Met, His, Ile, Leu Val, Ala, or Gly
  SITE (362)..(362): Xaa at position 362 is Leu, Ala, Val, Gly, or Ile
  SITE (365)..(365): Xaa at position 365 is Ile, Ala, Val, Leu, or Gly
  SITE (366)..(366): Xaa at position 366 is Val, Ala, Gly, Leu, or Ile
  SITE (367)..(367): Xaa at position 367 is Ala, Gly, or Pro
  SITE (369)..(369): Xaa at position 369 is Leu, Ala, Val, Gly, or Ile
  SITE (378)..(378): Xaa at position 378 is Ile, Ala, Val, Leu, or Gly
  SITE (379)..(379): Xaa at position 379 is Val, Ala, Gly, Leu, or Ile
  SITE (380)..(380): Xaa at position 380 is Phe, Tyr, Met, His, Ile, Leu, Val Ala, or Gly
  SITE (393)..(393): Xaa at position 393 is His, Phe, Tyr, Lys, Arg, Gly, Ser Thr, Ala, Val, Leu, Ile, Asn, Met, or Gln
  SITE (395)..(395): Xaa at position 395 is Phe, Tyr, Met, His, Ile, Leu, Val Ala, or Gly
  SITE (402)..(402): Xaa at position 402 is Phe, Tyr, Met, His, Ile, Leu, Val Ala, or Gly
  SITE (404)..(404): Xaa at position 404 is Cys, Ala, Val, Gly, Ser, or Thr
  SITE (409)..(409): Xaa at position 409 is Leu, Ala, Val, Gly, or Ile
  SITE (410)..(410): Xaa at position 410 is Phe, Tyr, Met, His, Ile, Leu, Val Ala, or Gly
  SITE (430)..(430): Xaa at position 430 is Leu, Ala, Val, Gly, or Ile
  SITE (432)..(432): Xaa at position 432 is Cys, Ala, Val, Gly, Ser, or Thr
  SITE (434)..(434): Xaa at position 434 is Ile, Ala, Val, Leu, or Gly
  SITE (437)..(437): Xaa at position 437 is Ile, Ala, Val, Leu, or Gly
  SITE (438)..(438): Xaa at position 438 is Ile, Ala, Val, Leu, or Gly
  SITE (444)..(444): Xaa at position 444 is Val, Ala, Gly, Leu, or Ile
  SITE (447)..(447): Xaa at position 447 is Ala, Gly, or Pro
  SITE (448)..(448): Xaa at position 448 is Met, Ile, Leu, Val, Ala, or Gly
  SITE (463)..(463): Xaa at position 463 is Ile, Ala, Val, Leu, or Gly
  SITE (466)..(466): Xaa at position 466 is Leu, Ala, Val, Gly, or Ile
  SITE (467)..(467): Xaa at position 467 is Leu, Ala, Val, Gly, or Ile
  SITE (468)..(468): Xaa at position 468 is Leu, Ala, Val, Gly, or Ile
  SITE (483)..(483): Xaa at position 483 is Ile, Ala, Val, Leu, or Gly
  SITE (484)..(484): Xaa at position 484 is Phe, Tyr, Met, His, Ile, Leu, Val Ala, or Gly
  SITE (495)..(495): Xaa at position 495 is Trp, Tyr, Phe, Met, His, Ile, Leu Val, Ala, or Gly
  SITE (499)..(499): Xaa at position 499 is Leu, Ala, Val, Gly, or Ile
  SITE (505)..(505): Xaa at position 505 is Val, Ala, Gly, Leu, or Ile
  SITE (507)..(507): Xaa at position 507 is Ile, Ala, Val, Leu, or Gly
  SITE (521)..(521): Xaa at position 521 is Val, Ala, Gly, Leu, or Ile
  SITE (565)..(565): Xaa at position 565 is Ile, Ala, Val, Leu, or Gly
  SITE (566)..(566): Xaa at position 566 is Val, Ala, Gly, Leu, or Ile
  SITE (572)..(572): Xaa at position 572 is Leu, Ala, Val, Gly, or Ile
  SITE (573)..(573): Xaa at position 573 is Leu, Ala, Val, Gly, or Ile
  SITE (575)..(575): Xaa at position 575 is Ala, Gly, or Pro
  SITE (576)..(576): Xaa at position 576 is Ile, Ala, Val, Leu, or Gly
  SITE (578)..(578): Xaa at position 578 is Ala, Gly, or Pro
  SITE (582)..(582): Xaa at position 582 is Leu, Ala, Val, Gly, or Ile
  SITE (583)..(583): Xaa at position 583 is Leu, Ala, Val, Gly, or Ile
  SITE (587)..(587): Xaa at position 587 is Val, Ala, Gly, Leu, or Ile
  SITE (590)..(590): Xaa at position 590 is Ile, Ala, Val, Leu, or Gly
  SITE (593)..(593): Xaa at position 593 is Leu, Ala, Val, Gly, or Ile
  SITE (597)..(597): Xaa at position 597 is Val, Ala, Gly, Leu, or Ile
  SITE (652)..(652): Xaa at position 652 is Ile, Ala, Val, Leu, or Gly
  SITE (659)..(659): Xaa at position 659 is Ile, Ala, Val, Leu, or Gly
AKEMRKHCQHLWRRGIMLLGMLMTCSAAENLWVTVYYGVPVWKEATTTLFCXSDAKAYETEVXNVWXTHACVPTDPNPQEVLLENVTENFNXWKNNXXEQXQEDIISLXDQSLKPCXKLTPLCXTLECHDVNVNGTANNGTTNVTESGVNSSDVTSNNVTNSNWGTMEKGEXKNCSFNITTNIRDKMQKETAQFYKLDIVPIEDQNKTNNTLYRLINCNTSVITQACPKVSFEPIPIHXXTPAGFXXLKXNDRNFNGTGPXKNXSTVQCTHGXKPVVSTQXXLNGSLAEAEXVIRSENFTNNAKTXXXQXNETXEXNXTRPNNNTSKRISIGPGRAFRATKIIGNXRQAHXNXSRATXNSTXKKXXXKXREQFGNKTXXXQPSSGGDPEIVMXSXNCGGEFXYXNTTQXXNSTWNSTEESNSTEEGTITXPXRXKQXXNMWQEXGKXXYAPPIEGQIRCSSNXTGXXXTRDGGNNNKTNGTEXXRPGGGDMRDNXRSEXYKYKVXKXEPLGVAPTKAKRRXVQREKRAVGIVGAMFLGFLGAAGSTMGAASMTLTVQARLLLSGXXQQQNNXXRXXEXQQHXXQLTXWGXKQXQARXLAVERYLKDQQLLGIWGCSGKLICTTTVPWNTSWSNKSLSEIWDNMTWMQWEREXDNYTSLXYTLIEESQNQQEKNEQELLELDKWAGLWNWFEITNWLWYIKIFIMIVGGLVGLRIVFAVLSIVNRVRQGYSPVSFQTHLPAPRGPDRPEGIEEEGGERDRGRSVRLVNGFLALIWDDLRSLCLFSYHRLRDLLLIIARIVELLGRRGWEALKYWWNLLQYWSQELKNSAVNLLDATAIAVAEGTDRIIEVVRRAFRAILHIPTRIRQGLERALL

SEQ ID NO: 763 - protein, 565 aa, Influenza A virus
  A/Viet Nam/1203/2004(H5N1)
  SITE (8)..(8): Xaa at position 8 is Phe, Tyr, Met, His, Ile, Leu, Val Ala, or Gly
  SITE (19)..(19): Xaa at position 19 is Ile, Ala, Val, Leu, or Gly
  SITE (20)..(20): Xaa at position 20 is Cys, Ala, Val, Gly, Ser, or Thr
  SITE (21)..(21): Xaa at position 21 is Ile, Ala, Val, Leu, or Gly
  SITE (25)..(25): Xaa at position 25 is Ala, Gly, or Pro
  SITE (32)..(32): Xaa at position 32 is Val, Ala, Gly, Leu, or Ile
  SITE (35)..(35): Xaa at position 35 is Ile, Ala, Val, Leu, or Gly
  SITE (42)..(42): Xaa at position 42 is Val, Ala, Gly, Leu, or Ile
  SITE (48)..(48): Xaa at position 48 is Ile, Ala, Val, Leu, or Gly
  SITE (49)..(49): Xaa at position 49 is Leu, Ala, Val, Gly, or Ile
  SITE (57)..(57): Xaa at position 57 is Leu, Ala, Val, Gly, or Ile
  SITE (58)..(58): Xaa at position 58 is Cys, Ala, Val, Gly, Ser, or Thr
  SITE (60)..(60): Xaa at position 60 is Leu, Ala, Val, Gly, or Ile
  SITE (66)..(66): Xaa at position 66 is Leu, Ala, Val, Gly, or Ile
  SITE (68)..(68): Xaa at position 68 is Leu, Ala, Val, Gly, or Ile
  SITE (71)..(71): Xaa at position 71 is Cys, Ala, Val, Gly, Ser, or Thr
  SITE (73)..(73): Xaa at position 73 is Val, Ala, Gly, Leu, or Ile
  SITE (74)..(74): Xaa at position 74 is Ala, Gly, or Pro
  SITE (76)..(76): Xaa at position 76 is Trp, Tyr, Phe, Met, His, Ile, Leu Val, Ala, or Gly
  SITE (77)..(77): Xaa at position 77 is Leu, Ala, Val, Gly, or Ile
  SITE (78)..(78): Xaa at position 78 is Leu, Ala, Val, Gly, or Ile
  SITE (83)..(83): Xaa at position 83 is Cys, Ala, Val, Gly, Ser, or Thr
  SITE (86)..(86): Xaa at position 86 is Phe, Tyr, Met, His, Ile, Leu, Val Ala, or Gly
  SITE (92)..(92): Xaa at position 92 is Trp, Tyr, Phe, Met, His, Ile, Leu Val, Ala, or Gly
  SITE (94)..(94): Xaa at position 94 is Tyr, Phe, Met, His, Ile, Leu, Val Ala, or Gly
  SITE (95)..(95): Xaa at position 95 is Ile, Ala, Val, Leu, or Gly
  SITE (96)..(96): Xaa at position 96 is Val, Ala, Gly, Leu, or Ile
  SITE (99)..(99): Xaa at position 99 is Ala, Gly, or Pro
  SITE (106)..(106): Xaa at position 106 is Cys, Ala, Val, Gly, Ser, or Thr
  SITE (107)..(107): Xaa at position 107 is Tyr, Phe, Met, His, Ile, Leu, Val Ala, or Gly
  SITE (117)..(117): Xaa at position 117 is Leu, Ala, Val, Gly, or Ile
  SITE (120)..(120): Xaa at position 120 is Leu, Ala, Val, Gly, or Ile
  SITE (121)..(121): Xaa at position 121 is Leu, Ala, Val, Gly, or Ile
  SITE (124)..(124): Xaa at position 124 is Ile, Ala, Val, Leu, or Gly
  SITE (127)..(127): Xaa at position 127 is Phe, Tyr, Met, His, Ile, Leu, Val Ala, or Gly
  SITE (133)..(133): Xaa at position 133 is Ile, Ala, Val, Leu, or Gly
  SITE (150)..(150): Xaa at position 150 is Ala, Gly, or Pro
  SITE (151)..(151): Xaa at position 151 is Cys, Ala, Val, Gly, Ser, or Thr
  SITE (153)..(153): Xaa at position 153 is Tyr, Phe, Met, His, Ile, Leu, Val Ala, or Gly
  SITE (163)..(163): Xaa at position 163 is Val, Ala, Gly, Leu, or Ile
  SITE (164)..(164): Xaa at position 164 is Val, Ala, Gly, Leu, or Ile
  SITE (165)..(165): Xaa at position 165 is Trp, Tyr, Phe, Met, His, Ile, Leu Val, Ala, or Gly
  SITE (166)..(166): Xaa at position 166 is Leu, Ala, Val, Gly, or Ile
  SITE (167)..(167): Xaa at position 167 is Ile, Ala, Val, Leu, or Gly
  SITE (176)..(176): Xaa at position 176 is Ile, Ala, Val, Leu, or Gly
  SITE (188)..(188): Xaa at position 188 is Leu, Ala, Val, Gly, or Ile
  SITE (189)..(189): Xaa at position 189 is Leu, Ala, Val, Gly, or Ile
  SITE (190)..(190): Xaa at position 190 is Val, Ala, Gly, Leu, or Ile
  SITE (191)..(191): Xaa at position 191 is Leu, Ala, Val, Gly, or Ile
  SITE (192)..(192): Xaa at position 192 is Trp, Tyr, Phe, Met, His, Ile, Leu Val, Ala, or Gly
  SITE (194)..(194): Xaa at position 194 is Ile, Ala, Val, Leu, or Gly
  SITE (195)..(195): Xaa at position 195 is His, Phe, Tyr, Lys, Arg, Gly, Ser Thr, Ala, Val, Leu, Ile, Asn, Met, or Gln
  SITE (196)..(196): Xaa at position 196 is His, Phe, Tyr, Lys, Arg, Gly, Ser Thr, Ala, Val, Leu, Ile, Asn, Met, or Gln
  SITE (201)..(201): Xaa at position 201 is Ala, Gly, or Pro
  SITE (207)..(207): Xaa at position 207 is Tyr, Phe, Met, His, Ile, Leu, Val Ala, or Gly
  SITE (213)..(213): Xaa at position 213 is Tyr, Phe, Met, His, Ile, Leu, Val Ala, or Gly
  SITE (214)..(214): Xaa at position 214 is Ile, Ala, Val, Leu, or Gly
  SITE (216)..(216): Xaa at position 216 is Val, Ala, Gly, Leu, or Ile
  SITE (221)..(221): Xaa at position 221 is Leu, Ala, Val, Gly, or Ile
  SITE (242)..(242): Xaa at position 242 is Met, Ile, Leu, Val, Ala, or Gly
  SITE (244)..(244): Xaa at position 244 is Phe, Tyr, Met, His, Ile, Leu, Val Ala, or Gly
  SITE (245)..(245): Xaa at position 245 is Phe, Tyr, Met, His, Ile, Leu, Val Ala, or Gly
  SITE (248)..(248): Xaa at position 248 is Ile, Ala, Val, Leu, or Gly
  SITE (249)..(249): Xaa at position 249 is Leu, Ala, Val, Gly, or Ile
  SITE (255)..(255): Xaa at position 255 is Ile, Ala, Val, Leu, or Gly
  SITE (257)..(257): Xaa at position 257 is Phe, Tyr, Met, His, Ile, Leu, Val Ala, or Gly
  SITE (263)..(263): Xaa at position 263 is Phe, Tyr, Met, His, Ile, Leu, Val Ala, or Gly
  SITE (264)..(264): Xaa at position 264 is Ile, Ala, Val, Leu, or Gly
  SITE (265)..(265): Xaa at position 265 is Ala, Gly, or Pro
  SITE (268)..(268): Xaa at position 268 is Tyr, Phe, Met, His, Ile, Leu, Val Ala, or Gly
  SITE (269)..(269): Xaa at position 269 is Ala, Gly, or Pro
  SITE (270)..(270): Xaa at position 270 is Tyr, Phe, Met, His, Ile, Leu, Val Ala, or Gly
  SITE (272)..(272): Xaa at position 272 is Ile, Ala, Val, Leu, or Gly
  SITE (280)..(280): Xaa at position 280 is Ile, Ala, Val, Leu, or Gly
  SITE (281)..(281): Xaa at position 281 is Met, Ile, Leu, Val, Ala, or Gly
  SITE (290)..(290): Xaa at position 290 is Cys, Ala, Val, Gly, Ser, or Thr
  SITE (294)..(294): Xaa at position 294 is Cys, Ala, Val, Gly, Ser, or Thr
  SITE (300)..(300): Xaa at position 300 is Ala, Gly, or Pro
  SITE (301)..(301): Xaa at position 301 is Ile, Ala, Val, Leu, or Gly
  SITE (308)..(308): Xaa at position 308 is His, Phe, Tyr, Lys, Arg, Gly, Ser Thr, Ala, Val, Leu, Ile, Asn, Met, or Gln
  SITE (311)..(311): Xaa at position 311 is His, Phe, Tyr, Lys, Arg, Gly, Ser Thr, Ala, Val, Leu, Ile, Asn, Met, or Gln
  SITE (315)..(315): Xaa at position 315 is Ile, Ala, Val, Leu, or Gly
  SITE (322)..(322): Xaa at position 322 is Val, Ala, Gly, Leu, or Ile
  SITE (327)..(327): Xaa at position 327 is Leu, Ala, Val, Gly, or Ile
  SITE (329)..(329): Xaa at position 329 is Leu, Ala, Val, Gly, or Ile
  SITE (330)..(330): Xaa at position 330 is Ala, Gly, or Pro
  SITE (351)..(351): Xaa at position 351 is Ala, Gly, or Pro
  SITE (363)..(363): Xaa at position 363 is Met, Ile, Leu, Val, Ala, or Gly
  SITE (368)..(368): Xaa at position 368 is Tyr, Phe, Met, His, Ile, Leu, Val Ala, or Gly
  SITE (390)..(390): Xaa at position 390 is Ala, Gly, or Pro
  SITE (391)..(391): Xaa at position 391 is Ile, Ala, Val, Leu, or Gly
  SITE (442)..(442): Xaa at position 442 is Ala, Gly, or Pro
  SITE (454)..(454): Xaa at position 454 is Leu, Ala, Val, Gly, or Ile
  SITE (461)..(461): Xaa at position 461 is Val, Ala, Gly, Leu, or Ile
  SITE (464)..(464): Xaa at position 464 is Leu, Ala, Val, Gly, or Ile
  SITE (468)..(468): Xaa at position 468 is Val, Ala, Gly, Leu, or Ile
  SITE (472)..(472): Xaa at position 472 is Leu, Ala, Val, Gly, or Ile
  SITE (483)..(483): Xaa at position 483 is Cys, Ala, Val, Gly, Ser, or Thr
  SITE (488)..(488): Xaa at position 488 is His, Phe, Tyr, Lys, Arg, Gly, Ser Thr, Ala, Val, Leu, Ile, Asn, Met, or Gln
  SITE (490)..(490): Xaa at position 490 is Cys, Ala, Val, Gly, Ser, or Thr
  SITE (494)..(494): Xaa at position 494 is Cys, Ala, Val, Gly, Ser, or Thr
  SITE (495)..(495): Xaa at position 495 is Met, Ile, Leu, Val, Ala, or Gly
  SITE (512)..(512): Xaa at position 512 is Ala, Gly, or Pro
MEKIVLLXAIVSLVKSDQXXXGYHXNNSTEQXDTXMEKNVTXTHAQDXXEKKHNGKXXDXDGVKPXIXRDXSXXGXXXGNPMXDEXINVPEXSXXXEKXNPVNDLXXPGDFNDYEEXKHXXSRXNHXEKIQIXPKSSWSSHEASLGVSSXXPXQGKSSFFRNXXXXXKKNSTYPTXKRSYNNTNQEDXXXXXGXXXPNDAXEQTKLXQNPTTXXSXGTSTXNQRLVPRIATRSKVNGQSGRXEXXWTXXKPNDAXNXESNGNXXXPEXXXKXVKKGDSTXXKSELEYGNXNTKXQTPMGXXNSSMPFXNIXPLTXGECPKYXKSNRXVXXTGLRNSPQRERRRKKRGLFGXIAGFIEGGWQGXVDGWXGYHHSNEQGSGYAADKESTQKXXDGVTNKVNSIIDKMNTQFEAVGREFNNLERRIENLNKKMEDGFLDVWTYNXELLVLMENERTXDFHDSNXKNXYDKXRLQXRDNAKELGNGXFEFYXKXDNEXXESVRNGTYDYPQYSEEXRLKREEISGVKLESIGIYQILSIYSTVASSLALAIMVAGLSLWMCSNGSLQCR

SEQ ID NO: 764 - protein, 1244 aa, Homo sapiens
  SITE (17)..(17): Xaa at position 17 is Val, Ala, Gly, Leu, or Ile
  SITE (23)..(23): Xaa at position 23 is Val, Ala, Gly, Leu, or Ile
  SITE (36)..(36): Xaa at position 36 is Tyr, Phe, Met, His, Ile, Leu, Val Ala, or Gly
  SITE (38)..(38): Xaa at position 38 is Ala, Gly, or Pro
  SITE (47)..(47): Xaa at position 47 is Val, Ala, Gly, Leu, or Ile
  SITE (49)..(49): Xaa at position 49 is Leu, Ala, Val, Gly, or Ile
  SITE (51)..(51): Xaa at position 51 is Val, Ala, Gly, Leu, or Ile
  SITE (67)..(67): Xaa at position 67 is Val, Ala, Gly, Leu, or Ile
  SITE (68)..(68): Xaa at position 68 is Leu, Ala, Val, Gly, or Ile
  SITE (71)..(71): Xaa at position 71 is Leu, Ala, Val, Gly, or Ile
  SITE (78)..(78): Xaa at position 78 is Cys, Ala, Val, Gly, Ser, or Thr
  SITE (92)..(92): Xaa at position 92 is Val, Ala, Gly, Leu, or Ile
  SITE (93)..(93): Xaa at position 93 is Val, Ala, Gly, Leu, or Ile
  SITE (101)..(101): Xaa at position 101 is Leu, Ala, Val, Gly, or Ile
  SITE (119)..(119): Xaa at position 119 is Leu, Ala, Val, Gly, or Ile
  SITE (121)..(121): Xaa at position 121 is Leu, Ala, Val, Gly, or Ile
  SITE (125)..(125): Xaa at position 125 is Ile, Ala, Val, Leu, or Gly
  SITE (126)..(126): Xaa at position 126 is Leu, Ala, Val, Gly, or Ile
  SITE (129)..(129): Xaa at position 129 is Ile, Ala, Val, Leu, or Gly
  SITE (132)..(132): Xaa at position 132 is Ile, Ala, Val, Leu, or Gly
  SITE (139)..(139): Xaa at position 139 is His, Phe, Tyr, Lys, Arg, Gly, Ser Thr, Ala, Val, Leu, Ile, Asn, Met, or Gln
  SITE (147)..(147): Xaa at position 147 is Phe, Tyr, Met, His, Ile, Leu, Val Ala, or Gly
  SITE (159)..(159): Xaa at position 159 is Cys, Ala, Val, Gly, Ser, or Thr
  SITE (161)..(161): Xaa at position 161 is Met, Ile, Leu, Val, Ala, or Gly
  SITE (209)..(209): Xaa at position 209 is Leu, Ala, Val, Gly, or Ile
  SITE (212)..(212): Xaa at position 212 is Leu, Ala, Val, Gly, or Ile
  SITE (213)..(213): Xaa at position 213 is Phe, Tyr, Met, His, Ile, Leu, Val Ala, or Gly
  SITE (214)..(214): Xaa at position 214 is Tyr, Phe, Met, His, Ile, Leu, Val Ala, or Gly
  SITE (215)..(215): Xaa at position 215 is Met, Ile, Leu, Val, Ala, or Gly
  SITE (216)..(216): Xaa at position 216 is Leu, Ala, Val, Gly, or Ile
  SITE (219)..(219): Xaa at position 219 is Phe, Tyr, Met, His, Ile, Leu, Val Ala, or Gly
  SITE (226)..(226): Xaa at position 226 is Trp, Tyr, Phe, Met, His, Ile, Leu Val, Ala, or Gly
  SITE (235)..(235): Xaa at position 235 is Val, Ala, Gly, Leu, or Ile
  SITE (255)..(255): Xaa at position 255 is Phe, Tyr, Met, His, Ile, Leu, Val Ala, or Gly
  SITE (258)..(258): Xaa at position 258 is Phe, Tyr, Met, His, Ile, Leu, Val Ala, or Gly
  SITE (262)..(262): Xaa at position 262 is Ile, Ala, Val, Leu, or Gly
  SITE (276)..(276): Xaa at position 276 is Leu, Ala, Val, Gly, or Ile
  SITE (279)..(279): Xaa at position 279 is Val, Ala, Gly, Leu, or Ile
  SITE (280)..(280): Xaa at position 280 is Phe, Tyr, Met, His, Ile, Leu, Val Ala, or Gly
  SITE (284)..(284): Xaa at position 284 is Ile, Ala, Val, Leu, or Gly
MSGGGEQLDILSVGILXKERWKXLRKIGGGGFGEIXDXLDMLTRENXAXKXESAQQPKQVLKMEVAXXKKXQGKDHVXRFIGCGRNDRFNYXXMQLQGRNXADLRRSQSRGTFTISTTXRXGRQXXESXESXHSVGFLXRDIKPSNXAMGRFPSTCRKXYXLDFGLARQFTNSCGDVRPPRAVAGFRGTVRYASINAHRNREMGRHDDXWSXXXXXVEXVVGQLPXRKIKDKEQXGSIKERYDHRLMLKHLPPEXSIXLDHXSSLDYFTKPDYQLXTSXXDNSXKTFGVIESDPFDWEKTGNDGSLTTTTTSTTPQLHTRLTPAAIGIANATPIPGDLLRENTDEVFPDEQLSDGENGIPVGVSPDKLPGSLGHPRPQEKDVWEEMDANKNKIKLGICKAATEEENSHGQANGLLNAPSLGSPIRVRSEITQPDRDIPLVRKLRSIHSFELEKRLTLEPKPDTDKFLETCLEKMQKDTSAGKESILPALLHKPCVPAVSRTDHIWHYDEEYLPDASKPASANTPEQADGGGSNGFIAVNLSSCKQEIDSKEWVIVDKEQDLQDFRTNEAVGHKTTGSPSDEEPEVLQVLEASPQDEKLQLGPWAENDHLKKETSGVVLALSAEGPPTAASEQYTDRLELQPGAASQFIAATPTSLMEAQAEGPLTAITIPRPSVASTQSTSGSFHCGQQPEKKDLQPMEPTVELYSPRENFSGLVVTEGEPPSGGSRTDLGLQIDHIGHDMLPNIRESNKSQDLGPKELPDHNRLVVREFENLPGETEEKSILLESDNEDEKLSRGQHCIEISSLPGDLVIVEKDHSATTEPLDVTKTQTFSVVPNQDKNNEIMKLLTVGTSEISSRDIDPHVEGQIGQVAEMQKNKISKDDDIMSEDLPGHQGDLSTFLHQEGKREKITPRNGELFHCVSENEHGAPTRKDMVRSSFVTRHSRIPVLAQEIDSTLESSSPVSAKEKLLQKKAYQPDLVKLLVEKRQFKSFLGDLSSASDKLLEEKLATVPAPFCEEEVLTPFSRLTVDSHLSRSAEDSFLSPIISQSRKSKIPRPVSWVNTDQVNSSTSSQFFPRPPPGKPPTRPGVEARLRRYKVLGSSNSDSDLFSRLAQILQNGSQKPRSTTQCKSPGSPHNPKTPPKSPVVPRRSPSASPRSSSLPRTSSSSPSRAGRPHHDQRSSSPHLGRSKSPPSHSGSSSSRRSCQQEHCKPSKNGLKGSGSLHHHSASTKTPQGKSKPASKLSR

SEQ ID NO: 765 - protein, 455 aa, Homo sapiens
  SITE (363)..(363): Xaa at position 363 is Phe, Tyr, Met, His, Ile, Leu, Val Ala, or Gly
  SITE (387)..(387): Xaa at position 387 is Cys, Ala, Val, Gly, Ser, or Thr
  SITE (401)..(401): Xaa at position 401 is Ala, Gly, or Pro
  SITE (430)..(430): Xaa at position 430 is Ile, Ala, Val, Leu, or Gly
  SITE (452)..(452): Xaa at position 452 is Cys, Ala, Val, Gly, Ser, or Thr
  SITE (454)..(454): Xaa at position 454 is Cys, Ala, Val, Gly, Ser, or Thr
MDTPRVLLSAVFLISFLWDLPGFQQASISSSSSSAELGSTKGMRSRKEGKMQRAPRDSDAGREGQEPQPRPQDEPRAQQPRAQEPPGRGPRVVPHEYMLSIYRTYSIAEKLGINASFFQSSKSANTITSFVDRGLDDLSHTPLRRQKYLFDVSMLSDKEELVGAELRLFRQAPSAPWGPPAGPLHVQLFPCLSPLLLDARTLDPQGAPPAGWEVFDVWQGLRHQPWKQLCLELRAAWGELDAGEAEARARGPQQPPPPDLRSLGFGRRVRPPQERALLVVFTRSQRKNLFAEMREQLGSAEAAGPGAGAEGSWPPPSGAPDARPWLPSPGRRRRRTAFASRHGKRHGKKSRLRCSKKPLHVNXKELGWDDWIIAPLEYEAYHCEGVXDFPLRSHLEPTNHXIIQTLMNSMDPGSTPPSCCVPTKLTPISXLYIDAGNNVVYKQYEDMVVESXGXR

SEQ ID NO: 766 - protein, 289 aa, Homo sapiens
  SITE (116)..(116): Xaa at position 116 is Ile, Ala, Val, Leu, or Gly
  SITE (123)..(123): Xaa at position 123 is Ala, Gly, or Pro
  SITE (149)..(149): Xaa at position 149 is Ile, Ala, Val, Leu, or Gly
  SITE (181)..(181): Xaa at position 181 is Ile, Ala, Val, Leu, or Gly
  SITE (188)..(188): Xaa at position 188 is Ala, Gly, or Pro
  SITE (190)..(190): Xaa at position 190 is Ile, Ala, Val, Leu, or Gly
  SITE (191)..(191): Xaa at position 191 is Leu, Ala, Val, Gly, or Ile
  SITE (192)..(192): Xaa at position 192 is Ile, Ala, Val, Leu, or Gly
  SITE (193)..(193): Xaa at position 193 is Leu, Ala, Val, Gly, or Ile
  SITE (194)..(194): Xaa at position 194 is Ile, Ala, Val, Leu, or Gly
  SITE (195)..(195): Xaa at position 195 is Phe, Tyr, Met, His, Ile, Leu, Val Ala, or Gly
MYFLTPILVAILCILVVWIFKNADRSMEKKKGEPRTRAEARPWVDEDLKDSSDLHQAEEDADEWQESEENVEHIPFSHNHYPEKEMVKRSQEFYELLNKRRSVRFISNEQVPMEVXDNVIRTXGTAPSGAHTEPWTFVVVKDPDVKHKXRKIIEEEEEINYMKRMGHRWVTDLKKLRTNWXKEYLDTXPXXXXXXKQVHGFAANGKKKVHYYNEISVSIACGILLAALQNAGLVTVTTTPLNCGPRLRVLLGRPAHEKLLMLLPVGYPSKEATVPDLKRKPLDQIMVTV

SEQ ID NO: 767 - protein, 1356 aa, Human coronavirus NL63
  HCoV-NL63
  SITE (485)..(485): Xaa at position 485 is Ile, Ala, Val, Leu, or Gly
  SITE (487)..(487): Xaa at position 487 is Phe, Tyr, Met, His, Ile, Leu, Val Ala, or Gly
  SITE (489)..(489): Xaa at position 489 is Ala, Gly, or Pro
  SITE (491)..(491): Xaa at position 491 is Ala, Gly, or Pro
  SITE (509)..(509): Xaa at position 509 is Leu, Ala, Val, Gly, or Ile
  SITE (541)..(541): Xaa at position 541 is Trp, Tyr, Phe, Met, His, Ile, Leu Val, Ala, or Gly
  SITE (577)..(577): Xaa at position 577 is Cys, Ala, Val, Gly, Ser, or Thr
  SITE (579)..(579): Xaa at position 579 is Phe, Tyr, Met, His, Ile, Leu, Val Ala, or Gly
  SITE (581)..(581): Xaa at position 581 is Leu, Ala, Val, Gly, or Ile
  SITE (583)..(583): Xaa at position 583 is Ala, Gly, or Pro
  SITE (596)..(596): Xaa at position 596 is Leu, Ala, Val, Gly, or Ile
  SITE (598)..(598): Xaa at position 598 is Val, Ala, Gly, Leu, or Ile
MKLFLILLVLPLASCFFTCNSNANLSMLQLGVPDNSSTIVTGLLPTHWFCANQSTSVYSANGFFYIDVGNHRSAFALHTGYYDANQYYIYVTNEIGLNASVTLKICKFSRNTTFDFLSNASSSFDCIVNLLFTEQLGAPLGITISGETVRLHLYNVTRTFYVPAAYKLTKLSVKCYFNYSCVFSVVNATVTVNVTTHNGRVVNYTVCDDCNGYTDNIFSVQQDGRIPNGFPFNNWFLLTNGSTLVDGVSRLYQPLRLTCLWPVPGLKSSTGFVYFNATGSDVNCNGYQHNSVVDVMRYNLNFSANSLDNLKSGVIVFKTLQYDVLFYCSNSSSGVLDTTIPFGPSSQPYYCFINSTINTTHVSTFVGILPPTVREIVVARTGQFYINGFKYFDLGFIEAVNFNVTTASATDFWTVAFATFVDVLVNVSATNIQNLLYCDSPFEKLQCEHLQFGLQDGFYSANFLDDNVLPETYVALPIYYQHTDXNXTXTXSFGGSCYVCKPHQVNISXNGNTSVCVRTSHFSIRYIYNRVKSGSPGDSSXHIYLKSGTCPFSFSKLNNFQKFKTICFSTVEVPGSXNXPXEXTWHYTSYTIVGAXYXTWSEGNSITGVPYPVSGIREFSNLVLNNCTKYNIYDYVGTGIIRSSNQSLAGGITYVSNSGNLLGFKNVSTGNIFIVTPCNQPDQVAVYQQSIIGAMTAVNESRYGLQNLLQLPNFYYVSNGGNNCTTAVMTYSNFGICADGSLIPVRPRNSSDNGISAIITANLSIPSNWTTSVQVEYLQITSTPIVVDCATYVCNGNPRCKNLLKQYTSACKTIEDALRLSAHLETNDVSSMLTFDSNAFSLANVTSFGDYNLSSVLPQRNIRSSRIAGRSALEDLLFSKVVTSGLGTVDVDYKSCTKGLSIADLACAQYYNGIMVLPGVADAERMAMYTGSLIGGMVLGGLTSAAAIPFSLALQARLNYVALQTDVLQENQKILAASFNKAINNIVASFSSVNDAITQTAEAIHTVTIALNKIQDVVNQQGSALNHLTSQLRHNFQAISNSIQAIYDRLDSIQADQQVDRLITGRLAALNAFVSQVLNKYTEVRGSRRLAQQKINECVKSQSNRYGFCGNGTHIFSIVNSAPDGLLFLHTVLLPTDYKNVKAWSGICVDGIYGYVLRQPNLVLYSDNGVFRVTSRVMFQPRLPVLSDFVQIYNCNVTFVNISRVELHTVIPDYVDVNKTLQEFAQNLPKYVKPNFDLTPFNLTYLNLSSELKQLEAKTASLFQTTVELQGLIDQINSTYVDLKLLNRFENYIKWPWWVWLIISVVFVVLLSLLVFCCLSTGCCGCCNCLTSSMRGCCDCGSTKLPYYEFEKVHVQ

SEQ ID NO: 768 - protein, 498 aa, Influenza A virus
  strain A/Equine/Santiago/1/1985 H3N8
  SITE (33)..(33): Xaa at position 33 is Val, Ala, Gly, Leu, or Ile
  SITE (36)..(36): Xaa at position 36 is Ile, Ala, Val, Leu, or Gly
  SITE (39)..(39): Xaa at position 39 is Phe, Tyr, Met, His, Ile, Leu, Val Ala, or Gly
  SITE (43)..(43): Xaa at position 43 is Met, Ile, Leu, Val, Ala, or Gly
  SITE (56)..(56): Xaa at position 56 is Leu, Ala, Val, Gly, or Ile
  SITE (57)..(57): Xaa at position 57 is Ile, Ala, Val, Leu, or Gly
  SITE (63)..(63): Xaa at position 63 is Ile, Ala, Val, Leu, or Gly
  SITE (66)..(66): Xaa at position 66 is Met, Ile, Leu, Val, Ala, or Gly
  SITE (67)..(67): Xaa at position 67 is Val, Ala, Gly, Leu, or Ile
  SITE (68)..(68): Xaa at position 68 is Leu, Ala, Val, Gly, or Ile
  SITE (70)..(70): Xaa at position 70 is Ala, Gly, or Pro
  SITE (96)..(96): Xaa at position 96 is Ile, Ala, Val, Leu, or Gly
  SITE (116)..(116): Xaa at position 116 is Ile, Ala, Val, Leu, or Gly
  SITE (119)..(119): Xaa at position 119 is Ile, Ala, Val, Leu, or Gly
  SITE (120)..(120): Xaa at position 120 is Trp, Tyr, Phe, Met, His, Ile, Leu Val, Ala, or Gly
  SITE (136)..(136): Xaa at position 136 is Met, Ile, Leu, Val, Ala, or Gly
  SITE (137)..(137): Xaa at position 137 is Met, Ile, Leu, Val, Ala, or Gly
  SITE (139)..(139): Xaa at position 139 is Trp, Tyr, Phe, Met, His, Ile, Leu Val, Ala, or Gly
  SITE (153)..(153): Xaa at position 153 is Ala, Gly, or Pro
  SITE (154)..(154): Xaa at position 154 is Leu, Ala, Val, Gly, or Ile
  SITE (163)..(163): Xaa at position 163 is Met, Ile, Leu, Val, Ala, or Gly
  SITE (189)..(189): Xaa at position 189 is Met, Ile, Leu, Val, Ala, or Gly
  SITE (190)..(190): Xaa at position 190 is Val, Ala, Gly, Leu, or Ile
  SITE (193)..(193): Xaa at position 193 is Leu, Ala, Val, Gly, or Ile
  SITE (194)..(194): Xaa at position 194 is Ile, Ala, Val, Leu, or Gly
  SITE (197)..(197): Xaa at position 197 is Ile, Ala, Val, Leu, or Gly
  SITE (201)..(201): Xaa at position 201 is Ile, Ala, Val, Leu, or Gly
  SITE (219)..(219): Xaa at position 219 is Tyr, Phe, Met, His, Ile, Leu, Val Ala, or Gly
  SITE (223)..(223): Xaa at position 223 is Cys, Ala, Val, Gly, Ser, or Thr
  SITE (226)..(226): Xaa at position 226 is Leu, Ala, Val, Gly, or Ile
  SITE (230)..(230): Xaa at position 230 is Phe, Tyr, Met, His, Ile, Leu, Val Ala, or Gly
  SITE (234)..(234): Xaa at position 234 is Ala, Gly, or Pro
  SITE (238)..(238): Xaa at position 238 is Met, Ile, Leu, Val, Ala, or Gly
  SITE (239)..(239): Xaa at position 239 is Met, Ile, Leu, Val, Ala, or Gly
  SITE (242)..(242): Xaa at position 242 is Val, Ala, Gly, Leu, or Ile
  SITE (256)..(256): Xaa at position 256 is Leu, Ala, Val, Gly, or Ile
  SITE (259)..(259): Xaa at position 259 is Leu, Ala, Val, Gly, or Ile
  SITE (263)..(263): Xaa at position 263 is Ala, Gly, or Pro
  SITE (265)..(265): Xaa at position 265 is Ile, Ala, Val, Leu, or Gly
  SITE (266)..(266): Xaa at position 266 is Leu, Ala, Val, Gly, or Ile
  SITE (275)..(275): Xaa at position 275 is Cys, Ala, Val, Gly, Ser, or Thr
  SITE (276)..(276): Xaa at position 276 is Leu, Ala, Val, Gly, or Ile
  SITE (278)..(278): Xaa at position 278 is Ala, Gly, or Pro
  SITE (281)..(281): Xaa at position 281 is Tyr, Phe, Met, His, Ile, Leu, Val Ala, or Gly
  SITE (291)..(291): Xaa at position 291 is Phe, Tyr, Met, His, Ile, Leu, Val Ala, or Gly
  SITE (296)..(296): Xaa at position 296 is Tyr, Phe, Met, His, Ile, Leu, Val Ala, or Gly
  SITE (307)..(307): Xaa at position 307 is Leu, Ala, Val, Gly, or Ile
  SITE (312)..(312): Xaa at position 312 is Ile, Ala, Val, Leu, or Gly
  SITE (315)..(315): Xaa at position 315 is Leu, Ala, Val, Gly, or Ile
  SITE (328)..(328): Xaa at position 328 is Leu, Ala, Val, Gly, or Ile
  SITE (329)..(329): Xaa at position 329 is Val, Ala, Gly, Leu, or Ile
  SITE (330)..(330): Xaa at position 330 is Trp, Tyr, Phe, Met, His, Ile, Leu Val, Ala, or Gly
  SITE (331)..(331): Xaa at position 331 is Met, Ile, Leu, Val, Ala, or Gly
  SITE (332)..(332): Xaa at position 332 is Ala, Gly, or Pro
  SITE (333)..(333): Xaa at position 333 is Cys, Ala, Val, Gly, Ser, or Thr
  SITE (334)..(334): Xaa at position 334 is His, Phe, Tyr, Lys, Arg, Gly, Ser Thr, Ala, Val, Leu, Ile, Asn, Met, or Gln
  SITE (336)..(336): Xaa at position 336 is Ala, Gly, or Pro
  SITE (337)..(337): Xaa at position 337 is Ala, Gly, or Pro
  SITE (341)..(341): Xaa at position 341 is Leu, Ala, Val, Gly, or Ile
  SITE (347)..(347): Xaa at position 347 is Ile, Ala, Val, Leu, or Gly
  SITE (352)..(352): Xaa at position 352 is Val, Ala, Gly, Leu, or Ile
  SITE (363)..(363): Xaa at position 363 is Val, Ala, Gly, Leu, or Ile
  SITE (371)..(371): Xaa at position 371 is Met, Ile, Leu, Val, Ala, or Gly
  SITE (381)..(381): Xaa at position 381 is Leu, Ala, Val, Gly, or Ile
  SITE (387)..(387): Xaa at position 387 is Ala, Gly, or Pro
  SITE (427)..(427): Xaa at position 427 is Ala, Gly, or Pro
  SITE (428)..(428): Xaa at position 428 is Ala, Gly, or Pro
  SITE (444)..(444): Xaa at position 444 is Ile, Ala, Val, Leu, or Gly
  SITE (487)..(487): Xaa at position 487 is Tyr, Phe, Met, His, Ile, Leu, Val Ala, or Gly
MASQGTKRSYEQMETGGERQNATEIRASVGRMXGGXGRXYVQXCTELKLNDHEGRXXQNSITXERXXXSXFDERRNKYLEEHPSAGKDPKKTGGPXYRRKDGKWMRELILHDKEEXMRXXRQANNGEDATAGLTHXXIXHSNLNDTTYQRTRXXVRAGMDPRXCSLMQGSTLPRRSGAAGAAVKGVGTXXMEXXRMXKRGXNDRNFWRGENGRRTRIAXERMXNIXKGKXQTAXQRAXXDQXRESRNPGNAEIEDXIFXTRSXLXXRGSVAHKSXXPXCVXGLAVASGYDXEKEGXSLVGIDPFKLXQNSQXFSXIRPKENPAHKSQXXXXXXXSXXFEDXRVLNFXRGTKXIPRGQLATRGXQIASNENXETIDSSTLEXRSRYWXIRTRSGGNTSQQRASAGQISVQPTFSVQRNLPFERATIMXXFTGNTEGRTSDMRTEXIRMMENARSEDVSFQGRGVFELSDEKATNPIVPSFDMSNEGSXFFGDNAEEFDS

SEQ ID NO: 769 - protein, 569 aa, Influenza A virus
  A/Netherlands/219/2003(H7N7)
  SITE (58)..(58): Xaa at position 58 is Val, Ala, Gly, Leu, or Ile
  SITE (66)..(66): Xaa at position 66 is Ile, Ala, Val, Leu, or Gly
  SITE (67)..(67): Xaa at position 67 is Cys, Ala, Val, Gly, Ser, or Thr
  SITE (76)..(76): Xaa at position 76 is Leu, Ala, Val, Gly, or Ile
  SITE (79)..(79): Xaa at position 79 is Cys, Ala, Val, Gly, Ser, or Thr
  SITE (81)..(81): Xaa at position 81 is Leu, Ala, Val, Gly, or Ile
  SITE (82)..(82): Xaa at position 82 is Leu, Ala, Val, Gly, or Ile
  SITE (85)..(85): Xaa at position 85 is Ile, Ala, Val, Leu, or Gly
  SITE (91)..(91): Xaa at position 91 is Cys, Ala, Val, Gly, Ser, or Thr
  SITE (99)..(99): Xaa at position 99 is Ala, Gly, or Pro
  SITE (101)..(101): Xaa at position 101 is Leu, Ala, Val, Gly, or Ile
  SITE (102)..(102): Xaa at position 102 is Ile, Ala, Val, Leu, or Gly
  SITE (103)..(103): Xaa at position 103 is Ile, Ala, Val, Leu, or Gly
  SITE (112)..(112): Xaa at position 112 is Cys, Ala, Val, Gly, Ser, or Thr
  SITE (123)..(123): Xaa at position 123 is Leu, Ala, Val, Gly, or Ile
  SITE (127)..(127): Xaa at position 127 is Leu, Ala, Val, Gly, or Ile
  SITE (133)..(133): Xaa at position 133 is Ile, Ala, Val, Leu, or Gly
  SITE (145)..(145): Xaa at position 145 is Ile, Ala, Val, Leu, or Gly
  SITE (154)..(154): Xaa at position 154 is Cys, Ala, Val, Gly, Ser, or Thr
  SITE (162)..(162): Xaa at position 162 is Tyr, Phe, Met, His, Ile, Leu, Val Ala, or Gly
  SITE (165)..(165): Xaa at position 165 is Met, Ile, Leu, Val, Ala, or Gly
  SITE (168)..(168): Xaa at position 168 is Leu, Ala, Val, Gly, or Ile
  SITE (184)..(184): Xaa at position 184 is Tyr, Phe, Met, His, Ile, Leu, Val Ala, or Gly
  SITE (192)..(192): Xaa at position 192 is Ala, Gly, or Pro
  SITE (193)..(193): Xaa at position 193 is Leu, Ala, Val, Gly, or Ile
  SITE (194)..(194): Xaa at position 194 is Ile, Ala, Val, Leu, or Gly
  SITE (195)..(195): Xaa at position 195 is Ile, Ala, Val, Leu, or Gly
  SITE (196)..(196): Xaa at position 196 is Trp, Tyr, Phe, Met, His, Ile, Leu Val, Ala, or Gly
  SITE (198)..(198): Xaa at position 198 is Ile, Ala, Val, Leu, or Gly
  SITE (199)..(199): Xaa at position 199 is His, Phe, Tyr, Lys, Arg, Gly, Ser Thr, Ala, Val, Leu, Ile, Asn, Met, or Gln
  SITE (211)..(211): Xaa at position 211 is Tyr, Phe, Met, His, Ile, Leu, Val Ala, or Gly
  SITE (218)..(218): Xaa at position 218 is Ile, Ala, Val, Leu, or Gly
  SITE (220)..(220): Xaa at position 220 is Val, Ala, Gly, Leu, or Ile
  SITE (246)..(246): Xaa at position 246 is Ile, Ala, Val, Leu, or Gly
  SITE (248)..(248): Xaa at position 248 is Phe, Tyr, Met, His, Ile, Leu, Val Ala, or Gly
  SITE (253)..(253): Xaa at position 253 is Leu, Ala, Val, Gly, or Ile
  SITE (259)..(259): Xaa at position 259 is Val, Ala, Gly, Leu, or Ile
  SITE (261)..(261): Xaa at position 261 is Phe, Tyr, Met, His, Ile, Leu, Val Ala, or Gly
  SITE (263)..(263): Xaa at position 263 is Phe, Tyr, Met, His, Ile, Leu, Val Ala, or Gly
  SITE (266)..(266): Xaa at position 266 is Ala, Gly, or Pro
  SITE (267)..(267): Xaa at position 267 is Phe, Tyr, Met, His, Ile, Leu, Val Ala, or Gly
  SITE (268)..(268): Xaa at position 268 is Ile, Ala, Val, Leu, or Gly
  SITE (269)..(269): Xaa at position 269 is Ala, Gly, or Pro
  SITE (270)..(270): Xaa at position 270 is Pro, Met, Leu, Ile, Val, Ala or Gly
  SITE (273)..(273): Xaa at position 273 is Ala, Gly, or Pro
  SITE (275)..(275): Xaa at position 275 is Phe, Tyr, Met, His, Ile, Leu, Val Ala, or Gly
  SITE (276)..(276): Xaa at position 276 is Leu, Ala, Val, Gly, or Ile
  SITE (283)..(283): Xaa at position 283 is Ile, Ala, Val, Leu, or Gly
  SITE (293)..(293): Xaa at position 293 is Cys, Ala, Val, Gly, Ser, or Thr
  SITE (297)..(297): Xaa at position 297 is Cys, Ala, Val, Gly, Ser, or Thr
  SITE (298)..(298): Xaa at position 298 is Tyr, Phe, Met, His, Ile, Leu, Val Ala, or Gly
  SITE (353)..(353): Xaa at position 353 is Ala, Gly, or Pro
  SITE (370)..(370): Xaa at position 370 is Tyr, Phe, Met, His, Ile, Leu, Val Ala, or Gly
  SITE (392)..(392): Xaa at position 392 is Ala, Gly, or Pro
  SITE (466)..(466): Xaa at position 466 is Leu, Ala, Val, Gly, or Ile
  SITE (474)..(474): Xaa at position 474 is Leu, Ala, Val, Gly, or Ile
  SITE (490)..(490): Xaa at position 490 is His, Phe, Tyr, Lys, Arg, Gly, Ser Thr, Ala, Val, Leu, Ile, Asn, Met, or Gln
  SITE (492)..(492): Xaa at position 492 is Cys, Ala, Val, Gly, Ser, or Thr
  SITE (496)..(496): Xaa at position 496 is Cys, Ala, Val, Gly, Ser, or Thr
  SITE (514)..(514): Xaa at position 514 is Ala, Gly, or Pro
SKSRGYKMNTQILVFALVASIPTNADKICLGHHAVSNGTKVNTLTERGVEVVNATETXERTNVPRXXSKGKRTVDXGQXGXXGTXTGPPQXDQFLEFSXDXXXERREGSDVXYPGKFVNEEAXRQIXRESGGXDKETMGFTYSGXRTNGTTSAXRRSGSSFXAEXKWXLSNTDNAAFPQMTKSXKNTRKDPXXXXXGXXHSGSTTEQTKLXGSGNKLXTXGSSNYQQSFVPSPGARPQVNGQSGRXDXHWLIXNPNDTXTXSXNGXXXXXDRXSXXRGKSMGXQSEVQVDANXEGDXXHSGGTIISNLPFQNINSRAVGKCPRYVKQESLLLATGMKNVPEIPKRRRRGLFGXIAGFIENGWEGLIDGWXGFRHQNAQGEGTAADYKSTQSXIDQITGKLNRLIEKTNQQFELIDNEFTEVERQIGNVINWTRDSMTEVWSYNAELLVAMENQHTIDLADSEMNKXYERVKRQXRENAEEDGTGCFEIFXKXDDDXMASIRNNTYDHSKYREEXIQNRIQIDPVKLSSGYKDVILWFSFGASCFILLAIAMGLVFICVKNGNMRCTICI

SEQ ID NO: 770 - protein, 470 aa, Influenza A virus
  strain A/Budgerigar/Hokkaido/1/1977 H4N6
  SITE (87)..(87): Xaa at position 87 is Leu, Ala, Val, Gly, or Ile
  SITE (94)..(94): Xaa at position 94 is Val, Ala, Gly, Leu, or Ile
  SITE (105)..(105): Xaa at position 105 is Ala, Gly, or Pro
  SITE (106)..(106): Xaa at position 106 is Ile, Ala, Val, Leu, or Gly
  SITE (114)..(114): Xaa at position 114 is Ile, Ala, Val, Leu, or Gly
  SITE (116)..(116): Xaa at position 116 is Val, Ala, Gly, Leu, or Ile
  SITE (121)..(121): Xaa at position 121 is Tyr, Phe, Met, His, Ile, Leu, Val Ala, or Gly
  SITE (122)..(122): Xaa at position 122 is Leu, Ala, Val, Gly, or Ile
  SITE (124)..(124): Xaa at position 124 is Cys, Ala, Val, Gly, Ser, or Thr
  SITE (131)..(131): Xaa at position 131 is Met, Ile, Leu, Val, Ala, or Gly
  SITE (132)..(132): Xaa at position 132 is Phe, Tyr, Met, His, Ile, Leu, Val Ala, or Gly
  SITE (133)..(133): Xaa at position 133 is Ala, Gly, or Pro
  SITE (134)..(134): Xaa at position 134 is Leu, Ala, Val, Gly, or Ile
  SITE (145)..(145): Xaa at position 145 is Ala, Gly, or Pro
  SITE (158)..(158): Xaa at position 158 is Leu, Ala, Val, Gly, or Ile
  SITE (159)..(159): Xaa at position 159 is Ile, Ala, Val, Leu, or Gly
  SITE (161)..(161): Xaa at position 161 is Trp, Tyr, Phe, Met, His, Ile, Leu Val, Ala, or Gly
  SITE (176)..(176): Xaa at position 176 is Cys, Ala, Val, Gly, Ser, or Thr
  SITE (177)..(177): Xaa at position 177 is Ile, Ala, Val, Leu, or Gly
  SITE (184)..(184): Xaa at position 184 is Cys, Ala, Val, Gly, Ser, or Thr
  SITE (191)..(191): Xaa at position 191 is Met, Ile, Leu, Val, Ala, or Gly
  SITE (193)..(193): Xaa at position 193 is Ile, Ala, Val, Leu, or Gly
  SITE (194)..(194): Xaa at position 194 is Cys, Ala, Val, Gly, Ser, or Thr
  SITE (195)..(195): Xaa at position 195 is Met, Ile, Leu, Val, Ala, or Gly
  SITE (202)..(202): Xaa at position 202 is Ala, Gly, or Pro
  SITE (204)..(204): Xaa at position 204 is Ala, Gly, or Pro
  SITE (205)..(205): Xaa at position 205 is Val, Ala, Gly, Leu, or Ile
  SITE (206)..(206): Xaa at position 206 is Val, Ala, Gly, Leu, or Ile
  SITE (208)..(208): Xaa at position 208 is Tyr, Phe, Met, His, Ile, Leu, Val Ala, or Gly
  SITE (220)..(220): Xaa at position 220 is Ala, Gly, or Pro
  SITE (224)..(224): Xaa at position 224 is Leu, Ala, Val, Gly, or Ile
  SITE (231)..(231): Xaa at position 231 is Cys, Ala, Val, Gly, Ser, or Thr
  SITE (232)..(232): Xaa at position 232 is Val, Ala, Gly, Leu, or Ile
  SITE (233)..(233): Xaa at position 233 is Cys, Ala, Val, Gly, Ser, or Thr
  SITE (240)..(240): Xaa at position 240 is Val, Ala, Gly, Leu, or Ile
  SITE (241)..(241): Xaa at position 241 is Val, Ala, Gly, Leu, or Ile
  SITE (242)..(242): Xaa at position 242 is Met, Ile, Leu, Val, Ala, or Gly
  SITE (255)..(255): Xaa at position 255 is Ile, Ala, Val, Leu, or Gly
  SITE (256)..(256): Xaa at position 256 is Ile, Ala, Val, Leu, or Gly
  SITE (257)..(257): Xaa at position 257 is Tyr, Phe, Met, His, Ile, Leu, Val Ala, or Gly
  SITE (258)..(258): Xaa at position 258 is Phe, Tyr, Met, His, Ile, Leu, Val Ala, or Gly
  SITE (276)..(276): Xaa at position 276 is Ile, Ala, Val, Leu, or Gly
  SITE (279)..(279): Xaa at position 279 is Cys, Ala, Val, Gly, Ser, or Thr
  SITE (281)..(281): Xaa at position 281 is Cys, Ala, Val, Gly, Ser, or Thr
  SITE (282)..(282): Xaa at position 282 is Tyr, Phe, Met, His, Ile, Leu, Val Ala, or Gly
  SITE (285)..(285): Xaa at position 285 is Val, Ala, Gly, Leu, or Ile
  SITE (288)..(288): Xaa at position 288 is Ile, Ala, Val, Leu, or Gly
  SITE (290)..(290): Xaa at position 290 is Cys, Ala, Val, Gly, Ser, or Thr
  SITE (291)..(291): Xaa at position 291 is Ile, Ala, Val, Leu, or Gly
  SITE (292)..(292): Xaa at position 292 is Cys, Ala, Val, Gly, Ser, or Thr
  SITE (299)..(299): Xaa at position 299 is Ala, Gly, or Pro
  SITE (303)..(303): Xaa at position 303 is Val, Ala, Gly, Leu, or Ile
  SITE (304)..(304): Xaa at position 304 is Ile, Ala, Val, Leu, or Gly
  SITE (306)..(306): Xaa at position 306 is Ile, Ala, Val, Leu, or Gly
  SITE (317)..(317): Xaa at position 317 is Tyr, Phe, Met, His, Ile, Leu, Val Ala, or Gly
  SITE (318)..(318): Xaa at position 318 is Leu, Ala, Val, Gly, or Ile
  SITE (319)..(319): Xaa at position 319 is Cys, Ala, Val, Gly, Ser, or Thr
  SITE (322)..(322): Xaa at position 322 is Val, Ala, Gly, Leu, or Ile
  SITE (323)..(323): Xaa at position 323 is Leu, Ala, Val, Gly, or Ile
  SITE (350)..(350): Xaa at position 350 is Val, Ala, Gly, Leu, or Ile
  SITE (353)..(353): Xaa at position 353 is Phe, Tyr, Met, His, Ile, Leu, Val Ala, or Gly
  SITE (354)..(354): Xaa at position 354 is Ala, Gly, or Pro
  SITE (355)..(355): Xaa at position 355 is Phe, Tyr, Met, His, Ile, Leu, Val Ala, or Gly
  SITE (362)..(362): Xaa at position 362 is Trp, Tyr, Phe, Met, His, Ile, Leu Val, Ala, or Gly
  SITE (363)..(363): Xaa at position 363 is Leu, Ala, Val, Gly, or Ile
  SITE (375)..(375): Xaa at position 375 is Tyr, Phe, Met, His, Ile, Leu, Val Ala, or Gly
  SITE (377)..(377): Xaa at position 377 is Met, Ile, Leu, Val, Ala, or Gly
  SITE (378)..(378): Xaa at position 378 is Leu, Ala, Val, Gly, or Ile
  SITE (380)..(380): Xaa at position 380 is Val, Ala, Gly, Leu, or Ile
  SITE (383)..(383): Xaa at position 383 is Ala, Gly, or Pro
  SITE (397)..(397): Xaa at position 397 is Ile, Ala, Val, Leu, or Gly
  SITE (398)..(398): Xaa at position 398 is Ile, Ala, Val, Leu, or Gly
  SITE (409)..(409): Xaa at position 409 is Ala, Gly, or Pro
  SITE (410)..(410): Xaa at position 410 is Phe, Tyr, Met, His, Ile, Leu, Val Ala, or Gly
  SITE (411)..(411): Xaa at position 411 is Ile, Ala, Val, Leu, or Gly
  SITE (420)..(420): Xaa at position 420 is Phe, Tyr, Met, His, Ile, Leu, Val Ala, or Gly
  SITE (424)..(424): Xaa at position 424 is Phe, Tyr, Met, His, Ile, Leu, Val Ala, or Gly
  SITE (425)..(425): Xaa at position 425 is Tyr, Phe, Met, His, Ile, Leu, Val Ala, or Gly
  SITE (426)..(426): Xaa at position 426 is Val, Ala, Gly, Leu, or Ile
  SITE (428)..(428): Xaa at position 428 is Leu, Ala, Val, Gly, or Ile
  SITE (438)..(438): Xaa at position 438 is Val, Ala, Gly, Leu, or Ile
  SITE (445)..(445): Xaa at position 445 is Ile, Ala, Val, Leu, or Gly
  SITE (446)..(446): Xaa at position 446 is Val, Ala, Gly, Leu, or Ile
  SITE (447)..(447): Xaa at position 447 is Ala, Gly, or Pro
  SITE (448)..(448): Xaa at position 448 is Leu, Ala, Val, Gly, or Ile
  SITE (464)..(464): Xaa at position 464 is Ala, Gly, or Pro
  SITE (466)..(466): Xaa at position 466 is Ile, Ala, Val, Leu, or Gly
MNPNQKIICISATGMTLSVVSLLIGIANLGLNIGLHYKVGDTPDANTPNVNETNSTTTIINNNTQNNFTNITNIIVSKNEERTFLNXTKPLCEXNSWHILSKDNXXRIGEDAHXLXTREPXXSXDPQGCRXXXXSQGTTLRGRHXNGTIHDRSPFRAXXSXEMGQAPSPYNVRVEXXGWSSTSXHDGISRXSXXXSGPNNNXSXXXWXGGRPVTEIPSWXGNIXRTQESEXXXHRGICPXXXTDGPANNRAATKXXXXKEGKIQKIEELAGNAQHXEEXSXXGAXGMXKXXXRDNWKGXNRPXXTXDSEMMTHTSKXXXSKXXTDTSRPNDPTNGDCDAPITGGSPDPGXKGXXXLDGENSXXGRTISKDSRSGXEXXKXPNXETDTRSEPTSHQVXXNNQNWSGYSGXXXDYWANKECXNPCXXXEXIRGRPKESSXLWTSNSXXXXCGSRERLGSWSWHDGXEXIYFK

SEQ ID NO: 771 - protein, 451 aa, Homo sapiens
  SITE (4)..(4): Xaa at position 4 is Cys, Ala, Val, Gly, Ser, or Thr
  SITE (5)..(5): Xaa at position 5 is Ile, Ala, Val, Leu, or Gly
  SITE (7)..(7): Xaa at position 7 is Ile, Ala, Val, Leu, or Gly
  SITE (8)..(8): Xaa at position 8 is His, Phe, Tyr, Lys, Arg, Gly, Ser Thr, Ala, Val, Leu, Ile, Asn, Met, or Gln
  SITE (9)..(9): Xaa at position 9 is Val, Ala, Gly, Leu, or Ile
  SITE (14)..(14): Xaa at position 14 is Val, Ala, Gly, Leu, or Ile
  SITE (16)..(16): Xaa at position 16 is Ile, Ala, Val, Leu, or Gly
  SITE (20)..(20): Xaa at position 20 is Cys, Ala, Val, Gly, Ser, or Thr
  SITE (21)..(21): Xaa at position 21 is Trp, Tyr, Phe, Met, His, Ile, Leu Val, Ala, or Gly
  SITE (23)..(23): Xaa at position 23 is Leu, Ala, Val, Gly, or Ile
  SITE (24)..(24): Xaa at position 24 is Tyr, Phe, Met, His, Ile, Leu, Val Ala, or Gly
  SITE (25)..(25): Xaa at position 25 is Cys, Ala, Val, Gly, Ser, or Thr
  SITE (28)..(28): Xaa at position 28 is His, Phe, Tyr, Lys, Arg, Gly, Ser Thr, Ala, Val, Leu, Ile, Asn, Met, or Gln
  SITE (30)..(30): Xaa at position 30 is Ile, Ala, Val, Leu, or Gly
  SITE (52)..(52): Xaa at position 52 is Phe, Tyr, Met, His, Ile, Leu, Val Ala, or Gly
  SITE (53)..(53): Xaa at position 53 is Phe, Tyr, Met, His, Ile, Leu, Val Ala, or Gly
  SITE (62)..(62): Xaa at position 62 is Val, Ala, Gly, Leu, or Ile
  SITE (65)..(65): Xaa at position 65 is Ala, Gly, or Pro
  SITE (66)..(66): Xaa at position 66 is Val, Ala, Gly, Leu, or Ile
  SITE (67)..(67): Xaa at position 67 is Phe, Tyr, Met, His, Ile, Leu, Val Ala, or Gly
  SITE (68)..(68): Xaa at position 68 is Val, Ala, Gly, Leu, or Ile
  SITE (70)..(70): Xaa at position 70 is Leu, Ala, Val, Gly, or Ile
  SITE (74)..(74): Xaa at position 74 is Val, Ala, Gly, Leu, or Ile
  SITE (75)..(75): Xaa at position 75 is Ile, Ala, Val, Leu, or Gly
  SITE (78)..(78): Xaa at position 78 is Val, Ala, Gly, Leu, or Ile
  SITE (86)..(86): Xaa at position 86 is Leu, Ala, Val, Gly, or Ile
  SITE (93)..(93): Xaa at position 93 is Ile, Ala, Val, Leu, or Gly
  SITE (99)..(99): Xaa at position 99 is Ala, Gly, or Pro
  SITE (100)..(100): Xaa at position 100 is Ala, Gly, or Pro
  SITE (103)..(103): Xaa at position 103 is Tyr, Phe, Met, His, Ile, Leu, Val Ala, or Gly
  SITE (104)..(104): Xaa at position 104 is Ala, Gly, or Pro
  SITE (115)..(115): Xaa at position 115 is Ile, Ala, Val, Leu, or Gly
  SITE (118)..(118): Xaa at position 118 is Val, Ala, Gly, Leu, or Ile
  SITE (119)..(119): Xaa at position 119 is Leu, Ala, Val, Gly, or Ile
  SITE (122)..(122): Xaa at position 122 is Ile, Ala, Val, Leu, or Gly
  SITE (125)..(125): Xaa at position 125 is Leu, Ala, Val, Gly, or Ile
  SITE (135)..(135): Xaa at position 135 is Phe, Tyr, Met, His, Ile, Leu, Val Ala, or Gly
  SITE (136)..(136): Xaa at position 136 is Leu, Ala, Val, Gly, or Ile
  SITE (137)..(137): Xaa at position 137 is Val, Ala, Gly, Leu, or Ile
  SITE (138)..(138): Xaa at position 138 is Phe, Tyr, Met, His, Ile, Leu, Val Ala, or Gly
  SITE (139)..(139): Xaa at position 139 is His, Phe, Tyr, Lys, Arg, Gly, Ser Thr, Ala, Val, Leu, Ile, Asn, Met, or Gln
  SITE (153)..(153): Xaa at position 153 is Leu, Ala, Val, Gly, or Ile
  SITE (154)..(154): Xaa at position 154 is Met, Ile, Leu, Val, Ala, or Gly
  SITE (157)..(157): Xaa at position 157 is Leu, Ala, Val, Gly, or Ile
  SITE (167)..(167): Xaa at position 167 is Leu, Ala, Val, Gly, or Ile
  SITE (169)..(169): Xaa at position 169 is Phe, Tyr, Met, His, Ile, Leu, Val Ala, or Gly
  SITE (172)..(172): Xaa at position 172 is Tyr, Phe, Met, His, Ile, Leu, Val Ala, or Gly
  SITE (174)..(174): Xaa at position 174 is Ala, Gly, or Pro
  SITE (185)..(185): Xaa at position 185 is Tyr, Phe, Met, His, Ile, Leu, Val Ala, or Gly
  SITE (188)..(188): Xaa at position 188 is Ile, Ala, Val, Leu, or Gly
  SITE (189)..(189): Xaa at position 189 is Leu, Ala, Val, Gly, or Ile
  SITE (195)..(195): Xaa at position 195 is Leu, Ala, Val, Gly, or Ile
  SITE (200)..(200): Xaa at position 200 is Cys, Ala, Val, Gly, Ser, or Thr
  SITE (201)..(201): Xaa at position 201 is Ala, Gly, or Pro
  SITE (202)..(202): Xaa at position 202 is Phe, Tyr, Met, His, Ile, Leu, Val Ala, or Gly
  SITE (203)..(203): Xaa at position 203 is Met, Ile, Leu, Val, Ala, or Gly
  SITE (204)..(204): Xaa at position 204 is Val, Ala, Gly, Leu, or Ile
  SITE (208)..(208): Xaa at position 208 is Ala, Gly, or Pro
  SITE (209)..(209): Xaa at position 209 is Ile, Ala, Val, Leu, or Gly
  SITE (212)..(212): Xaa at position 212 is Ile, Ala, Val, Leu, or Gly
  SITE (213)..(213): Xaa at position 213 is Cys, Ala, Val, Gly, Ser, or Thr
  SITE (227)..(227): Xaa at position 227 is Leu, Ala, Val, Gly, or Ile
  SITE (230)..(230): Xaa at position 230 is Leu, Ala, Val, Gly, or Ile
  SITE (231)..(231): Xaa at position 231 is Ile, Ala, Val, Leu, or Gly
  SITE (234)..(234): Xaa at position 234 is Ile, Ala, Val, Leu, or Gly
  SITE (235)..(235): Xaa at position 235 is Val, Ala, Gly, Leu, or Ile
  SITE (238)..(238): Xaa at position 238 is Ile, Ala, Val, Leu, or Gly
  SITE (240)..(240): Xaa at position 240 is Ala, Gly, or Pro
  SITE (242)..(242): Xaa at position 242 is Leu, Ala, Val, Gly, or Ile
  SITE (250)..(250): Xaa at position 250 is Val, Ala, Gly, Leu, or Ile
  SITE (252)..(252): Xaa at position 252 is Leu, Ala, Val, Gly, or Ile
  SITE (255)..(255): Xaa at position 255 is Phe, Tyr, Met, His, Ile, Leu, Val Ala, or Gly
  SITE (259)..(259): Xaa at position 259 is Leu, Ala, Val, Gly, or Ile
  SITE (260)..(260): Xaa at position 260 is Val, Ala, Gly, Leu, or Ile
  SITE (265)..(265): Xaa at position 265 is Ile, Ala, Val, Leu, or Gly
  SITE (266)..(266): Xaa at position 266 is His, Phe, Tyr, Lys, Arg, Gly, Ser Thr, Ala, Val, Leu, Ile, Asn, Met, or Gln
  SITE (267)..(267): Xaa at position 267 is Phe, Tyr, Met, His, Ile, Leu, Val Ala, or Gly
  SITE (269)..(269): Xaa at position 269 is Leu, Ala, Val, Gly, or Ile
  SITE (270)..(270): Xaa at position 270 is Ala, Gly, or Pro
  SITE (273)..(273): Xaa at position 273 is Ala, Gly, or Pro
  SITE (288)..(288): Xaa at position 288 is Val, Ala, Gly, Leu, or Ile
  SITE (291)..(291): Xaa at position 291 is Ile, Ala, Val, Leu, or Gly
  SITE (295)..(295): Xaa at position 295 is Cys, Ala, Val, Gly, Ser, or Thr
  SITE (302)..(302): Xaa at position 302 is Met, Ile, Leu, Val, Ala, or Gly
  SITE (303)..(303): Xaa at position 303 is Val, Ala, Gly, Leu, or Ile
  SITE (305)..(305): Xaa at position 305 is Cys, Ala, Val, Gly, Ser, or Thr
  SITE (312)..(312): Xaa at position 312 is Tyr, Phe, Met, His, Ile, Leu, Val Ala, or Gly
  SITE (313)..(313): Xaa at position 313 is Met, Ile, Leu, Val, Ala, or Gly
  SITE (315)..(315): Xaa at position 315 is Cys, Ala, Val, Gly, Ser, or Thr
  SITE (316)..(316): Xaa at position 316 is Cys, Ala, Val, Gly, Ser, or Thr
  SITE (317)..(317): Xaa at position 317 is Leu, Ala, Val, Gly, or Ile
  SITE (318)..(318): Xaa at position 318 is Leu, Ala, Val, Gly, or Ile
  SITE (319)..(319): Xaa at position 319 is Tyr, Phe, Met, His, Ile, Leu, Val Ala, or Gly
  SITE (323)..(323): Xaa at position 323 is Val, Ala, Gly, Leu, or Ile
  SITE (328)..(328): Xaa at position 328 is Val, Ala, Gly, Leu, or Ile
  SITE (331)..(331): Xaa at position 331 is Ala, Gly, or Pro
  SITE (335)..(335): Xaa at position 335 is Ile, Ala, Val, Leu, or Gly
  SITE (344)..(344): Xaa at position 344 is Val, Ala, Gly, Leu, or Ile
  SITE (355)..(355): Xaa at position 355 is Ile, Ala, Val, Leu, or Gly
  SITE (363)..(363): Xaa at position 363 is Val, Ala, Gly, Leu, or Ile
  SITE (369)..(369): Xaa at position 369 is Ala, Gly, or Pro
  SITE (374)..(374): Xaa at position 374 is Ala, Gly, or Pro
  SITE (375)..(375): Xaa at position 375 is Val, Ala, Gly, Leu, or Ile
  SITE (376)..(376): Xaa at position 376 is Cys, Ala, Val, Gly, Ser, or Thr
  SITE (377)..(377): Xaa at position 377 is Met, Ile, Leu, Val, Ala, or Gly
  SITE (378)..(378): Xaa at position 378 is Leu, Ala, Val, Gly, or Ile
  SITE (383)..(383): Xaa at position 383 is Ala, Gly, or Pro
  SITE (384)..(384): Xaa at position 384 is Ile, Ala, Val, Leu, or Gly
  SITE (387)..(387): Xaa at position 387 is Ala, Gly, or Pro
  SITE (388)..(388): Xaa at position 388 is Trp, Tyr, Phe, Met, His, Ile, Leu Val, Ala, or Gly
  SITE (391)..(391): Xaa at position 391 is Leu, Ala, Val, Gly, or Ile
  SITE (395)..(395): Xaa at position 395 is Phe, Tyr, Met, His, Ile, Leu, Val Ala, or Gly
  SITE (399)..(399): Xaa at position 399 is Tyr, Phe, Met, His, Ile, Leu, Val Ala, or Gly
  SITE (408)..(408): Xaa at position 408 is Tyr, Phe, Met, His, Ile, Leu, Val Ala, or Gly
  SITE (418)..(418): Xaa at position 418 is Phe, Tyr, Met, His, Ile, Leu, Val Ala, or Gly
  SITE (421)..(421): Xaa at position 421 is Ala, Gly, or Pro
  SITE (425)..(425): Xaa at position 425 is Met, Ile, Leu, Val, Ala, or Gly
  SITE (428)..(428): Xaa at position 428 is Leu, Ala, Val, Gly, or Ile
  SITE (432)..(432): Xaa at position 432 is Tyr, Phe, Met, His, Ile, Leu, Val Ala, or Gly
MREXXSXXXGQAGXQXGNAXXEXXXLEXGXQPDGQMPSDKTIGGGDDSFNTXXSETGAGKHXPRXXXXDXEPTXXDEXRTGTYRQXFHPEQLXTGKEDXXNNXXRGHYTIGKEIXDLXXDRXRKXADQCTGLQGXXXXXSFGGGTGSGFTSLXXERXSVDYGKKSKXEXSIXPXPQVSTAVVEPXNSXXTTHTTXEHSDXXXXXDNEXXYDXXRRNLDIERPTYTNXNRXXGQXXSSXTXSXRFDGALNXDXTEXQTNXXPYPRXXXPXXTYXPVISAEKAYHEQLSXAEXTNAXFEPANQXXKXDPRHGKXXAXXXXXRGDXVPKDXNAXIATXKTKRTIQFXDWCPTGFKVGXNYQPPTVXPGGDLXKVQRXXXXXSNTTXXAEXXARXDHKXDLMXAKRAFVHWXVGEGMEEGEXSEXREDXAAXEKDXEEVGVDSVEGEGEEEGEEY

SEQ ID NO: 772 - protein, 847 aa, Human immunodeficiency virus 1
  SITE (54)..(54): Xaa at position 54 is Ala, Gly, or Pro
  SITE (69)..(69): Xaa at position 69 is Ala, Gly, or Pro
  SITE (94)..(94): Xaa at position 94 is Met, Ile, Leu, Val, Ala, or Gly
  SITE (99)..(99): Xaa at position 99 is Met, Ile, Leu, Val, Ala, or Gly
  SITE (100)..(100): Xaa at position 100 is Val, Ala, Gly, Leu, or Ile
  SITE (103)..(103): Xaa at position 103 is Met, Ile, Leu, Val, Ala, or Gly
  SITE (107)..(107): Xaa at position 107 is Ile, Ala, Val, Leu, or Gly
  SITE (119)..(119): Xaa at position 119 is Val, Ala, Gly, Leu, or Ile
  SITE (121)..(121): Xaa at position 121 is Leu, Ala, Val, Gly, or Ile
  SITE (126)..(126): Xaa at position 126 is Val, Ala, Gly, Leu, or Ile
  SITE (151)..(151): Xaa at position 151 is Ile, Ala, Val, Leu, or Gly
  SITE (154)..(154): Xaa at position 154 is Cys, Ala, Val, Gly, Ser, or Thr
  SITE (171)..(171): Xaa at position 171 is Ala, Gly, or Pro
  SITE (190)..(190): Xaa at position 190 is Leu, Ala, Val, Gly, or Ile
  SITE (221)..(221): Xaa at position 221 is Ala, Gly, or Pro
  SITE (222)..(222): Xaa at position 222 is Ile, Ala, Val, Leu, or Gly
  SITE (225)..(225): Xaa at position 225 is Cys, Ala, Val, Gly, Ser, or Thr
  SITE (236)..(236): Xaa at position 236 is Cys, Ala, Val, Gly, Ser, or Thr
  SITE (256)..(256): Xaa at position 256 is Leu, Ala, Val, Gly, or Ile
  SITE (257)..(257): Xaa at position 257 is Leu, Ala, Val, Gly, or Ile
  SITE (267)..(267): Xaa at position 267 is Val, Ala, Gly, Leu, or Ile
  SITE (281)..(281): Xaa at position 281 is Ile, Ala, Val, Leu, or Gly
  SITE (282)..(282): Xaa at position 282 is Ile, Ala, Val, Leu, or Gly
  SITE (283)..(283): Xaa at position 283 is Val, Ala, Gly, Leu, or Ile
  SITE (285)..(285): Xaa at position 285 is Leu, Ala, Val, Gly, or Ile
  SITE (289)..(289): Xaa at position 289 is Val, Ala, Gly, Leu, or Ile
  SITE (291)..(291): Xaa at position 291 is Ile, Ala, Val, Leu, or Gly
  SITE (293)..(293): Xaa at position 293 is Cys, Ala, Val, Gly, Ser, or Thr
  SITE (312)..(312): Xaa at position 312 is Phe, Tyr, Met, His, Ile, Leu, Val Ala, or Gly
  SITE (322)..(322): Xaa at position 322 is Ile, Ala, Val, Leu, or Gly
  SITE (325)..(325): Xaa at position 325 is Ala, Gly, or Pro
  SITE (327)..(327): Xaa at position 327 is Cys, Ala, Val, Gly, Ser, or Thr
  SITE (329)..(329): Xaa at position 329 is Ile, Ala, Val, Leu, or Gly
  SITE (334)..(334): Xaa at position 334 is Trp, Tyr, Phe, Met, His, Ile, Leu Val, Ala, or Gly
  SITE (338)..(338): Xaa at position 338 is Leu, Ala, Val, Gly, or Ile
  SITE (341)..(341): Xaa at position 341 is Ile, Ala, Val, Leu, or Gly
  SITE (342)..(342): Xaa at position 342 is Val, Ala, Gly, Leu, or Ile
  SITE (343)..(343): Xaa at position 343 is Ile, Ala, Val, Leu, or Gly
  SITE (345)..(345): Xaa at position 345 is Leu, Ala, Val, Gly, or Ile
  SITE (354)..(354): Xaa at position 354 is Ile, Ala, Val, Leu, or Gly
  SITE (355)..(355): Xaa at position 355 is Val, Ala, Gly, Leu, or Ile
  SITE (356)..(356): Xaa at position 356 is Phe, Tyr, Met, His, Ile, Leu, Val Ala, or Gly
  SITE (369)..(369): Xaa at position 369 is His, Phe, Tyr, Lys, Arg, Gly, Ser Thr, Ala, Val, Leu, Ile, Asn, Met, or Gln
  SITE (371)..(371): Xaa at position 371 is Phe, Tyr, Met, His, Ile, Leu, Val Ala, or Gly
  SITE (373)..(373): Xaa at position 373 is Cys, Ala, Val, Gly, Ser, or Thr
  SITE (378)..(378): Xaa at position 378 is Phe, Tyr, Met, His, Ile, Leu, Val Ala, or Gly
  SITE (380)..(380): Xaa at position 380 is Cys, Ala, Val, Gly, Ser, or Thr
  SITE (385)..(385): Xaa at position 385 is Leu, Ala, Val, Gly, or Ile
  SITE (386)..(386): Xaa at position 386 is Phe, Tyr, Met, His, Ile, Leu, Val Ala, or Gly
  SITE (407)..(407): Xaa at position 407 is Leu, Ala, Val, Gly, or Ile
  SITE (409)..(409): Xaa at position 409 is Cys, Ala, Val, Gly, Ser, or Thr
  SITE (411)..(411): Xaa at position 411 is Ile, Ala, Val, Leu, or Gly
  SITE (414)..(414): Xaa at position 414 is Ile, Ala, Val, Leu, or Gly
  SITE (415)..(415): Xaa at position 415 is Ile, Ala, Val, Leu, or Gly
  SITE (421)..(421): Xaa at position 421 is Val, Ala, Gly, Leu, or Ile
  SITE (424)..(424): Xaa at position 424 is Ala, Gly, or Pro
  SITE (425)..(425): Xaa at position 425 is Met, Ile, Leu, Val, Ala, or Gly
  SITE (440)..(440): Xaa at position 440 is Ile, Ala, Val, Leu, or Gly
  SITE (443)..(443): Xaa at position 443 is Leu, Ala, Val, Gly, or Ile
  SITE (444)..(444): Xaa at position 444 is Leu, Ala, Val, Gly, or Ile
  SITE (445)..(445): Xaa at position 445 is Leu, Ala, Val, Gly, or Ile
  SITE (458)..(458): Xaa at position 458 is Ile, Ala, Val, Leu, or Gly
  SITE (459)..(459): Xaa at position 459 is Phe, Tyr, Met, His, Ile, Leu, Val Ala, or Gly
  SITE (470)..(470): Xaa at position 470 is Trp, Tyr, Phe, Met, His, Ile, Leu Val, Ala, or Gly
  SITE (474)..(474): Xaa at position 474 is Leu, Ala, Val, Gly, or Ile
  SITE (477)..(477): Xaa at position 477 is Tyr, Phe, Met, His, Ile, Leu, Val Ala, or Gly
  SITE (480)..(480): Xaa at position 480 is Val, Ala, Gly, Leu, or Ile
  SITE (482)..(482): Xaa at position 482 is Ile, Ala, Val, Leu, or Gly
  SITE (496)..(496): Xaa at position 496 is Val, Ala, Gly, Leu, or Ile
  SITE (539)..(539): Xaa at position 539 is Ile, Ala, Val, Leu, or Gly
  SITE (540)..(540): Xaa at position 540 is Val, Ala, Gly, Leu, or Ile
  SITE (546)..(546): Xaa at position 546 is Leu, Ala, Val, Gly, or Ile
  SITE (547)..(547): Xaa at position 547 is Leu, Ala, Val, Gly, or Ile
  SITE (549)..(549): Xaa at position 549 is Ala, Gly, or Pro
  SITE (550)..(550): Xaa at position 550 is Ile, Ala, Val, Leu, or Gly
  SITE (552)..(552): Xaa at position 552 is Ala, Gly, or Pro
  SITE (556)..(556): Xaa at position 556 is Met, Ile, Leu, Val, Ala, or Gly
  SITE (557)..(557): Xaa at position 557 is Leu, Ala, Val, Gly, or Ile
  SITE (561)..(561): Xaa at position 561 is Val, Ala, Gly, Leu, or Ile
  SITE (564)..(564): Xaa at position 564 is Ile, Ala, Val, Leu, or Gly
  SITE (567)..(567): Xaa at position 567 is Leu, Ala, Val, Gly, or Ile
  SITE (571)..(571): Xaa at position 571 is Val, Ala, Gly, Leu, or Ile
  SITE (626)..(626): Xaa at position 626 is Ile, Ala, Val, Leu, or Gly
  SITE (633)..(633): Xaa at position 633 is Ile, Ala, Val, Leu, or Gly
MRVKGIRKSYQYLWKGGTLLLGILMICSAVEKLWVTVYYGVPVWKEATTTLFCXSDAKAYDTEVHNVWXTHACVPTDPNPQEVVLENVTEHFNXWKNNXXEQXQEDXISLWDQSLKPCXKXTPLCXTLNCKDVNATNTTNDSEGTMERGEXKNXSFNITTSIRDEVQKEYXLFYKLDVVPIDNNNTSYRXISCDTSVITQACPKISFEPIPIHYCAPAGFXXLKXNDKTFNGKGPXKNVSTVQCTHGIRPVVSTQXXLNGSLAEEEXVIRSDNFTNNAKTXXXQXKESXEXNXTRPNNNTRKSIHIGPGRAXYTTGEIIGDXRQXHXNXSRAKXNDTXKQXXXKXREQFENKTXXXNHSSGGDPEIVMXSXNXGGEFXYXNSTQXXNSTWNNNTEGSNNTEGNTITXPXRXKQXXNMWQEXGKXXYAPPIRGQIRCSSNXTGXXXTRDGGINENGTEXXRPGGGDMRDNXRSEXYKXKVXKXEPLGVAPTKAKRRXVQREKRAVGIGAVFLGFLGAAGSTMGAASMTLTVQARLLLSGXXQQQNNXXRXXEXQQRXXQLTXWGXKQXQARXLAVERYLGDQQLLGIWGCSGKLICTTAVPWNASWSNKSLDRIWNNMTWMEWEREXDNYTSEXYTLIEESQNQQEKNEQELLELDKWASLWNWFDITKWLWYIKIFIMIVGGLVGLRLVFTVLSIVNRVRQGYSPLSFQTLLPAPRGPDRPEGIEEEGGERDRDRSGRLVNGFLALIWVDLRSLCLFSYHRLRDLLLTVTRIVELLGRRGWEVLKYWWNLLQYWSQELKNSAVSLLNATAIAVAEGTDRIIEALQRTYRAILHIPTRIRQGLERALL

SEQ ID NO: 773 - protein, 258 aa, Homo sapiens
  SITE (50)..(50): Xaa at position 50 is Val, Ala, Gly, Leu, or Ile
  SITE (52)..(52): Xaa at position 52 is Cys, Ala, Val, Gly, Ser, or Thr
  SITE (53)..(53): Xaa at position 53 is Val, Ala, Gly, Leu, or Ile
  SITE (54)..(54): Xaa at position 54 is Leu, Ala, Val, Gly, or Ile
  SITE (55)..(55): Xaa at position 55 is Val, Ala, Gly, Leu, or Ile
  SITE (60)..(60): Xaa at position 60 is Val, Ala, Gly, Leu, or Ile
  SITE (65)..(65): Xaa at position 65 is Leu, Ala, Val, Gly, or Ile
  SITE (66)..(66): Xaa at position 66 is Val, Ala, Gly, Leu, or Ile
  SITE (74)..(74): Xaa at position 74 is Tyr, Phe, Met, His, Ile, Leu, Val Ala, or Gly
  SITE (82)..(82): Xaa at position 82 is Ala, Gly, or Pro
  SITE (90)..(90): Xaa at position 90 is Val, Ala, Gly, Leu, or Ile
  SITE (92)..(92): Xaa at position 92 is Val, Ala, Gly, Leu, or Ile
  SITE (97)..(97): Xaa at position 97 is Val, Ala, Gly, Leu, or Ile
  SITE (99)..(99): Xaa at position 99 is Leu, Ala, Val, Gly, or Ile
  SITE (101)..(101): Xaa at position 101 is Leu, Ala, Val, Gly, or Ile
  SITE (105)..(105): Xaa at position 105 is Ala, Gly, or Pro
  SITE (118)..(118): Xaa at position 118 is Tyr, Phe, Met, His, Ile, Leu, Val Ala, or Gly
  SITE (123)..(123): Xaa at position 123 is Ile, Ala, Val, Leu, or Gly
  SITE (124)..(124): Xaa at position 124 is Phe, Tyr, Met, His, Ile, Leu, Val Ala, or Gly
  SITE (125)..(125): Xaa at position 125 is Leu, Ala, Val, Gly, or Ile
  SITE (126)..(126): Xaa at position 126 is Leu, Ala, Val, Gly, or Ile
  SITE (127)..(127): Xaa at position 127 is Cys, Ala, Val, Gly, Ser, or Thr
  SITE (128)..(128): Xaa at position 128 is Phe, Tyr, Met, His, Ile, Leu, Val Ala, or Gly
  SITE (130)..(130): Xaa at position 130 is Val, Ala, Gly, Leu, or Ile
  SITE (136)..(136): Xaa at position 136 is Phe, Tyr, Met, His, Ile, Leu, Val Ala, or Gly
  SITE (139)..(139): Xaa at position 139 is Val, Ala, Gly, Leu, or Ile
  SITE (143)..(143): Xaa at position 143 is Trp, Tyr, Phe, Met, His, Ile, Leu Val, Ala, or Gly
  SITE (144)..(144): Xaa at position 144 is Val, Ala, Gly, Leu, or Ile
  SITE (147)..(147): Xaa at position 147 is Ile, Ala, Val, Leu, or Gly
  SITE (151)..(151): Xaa at position 151 is Cys, Ala, Val, Gly, Ser, or Thr
  SITE (156)..(156): Xaa at position 156 is Ile, Ala, Val, Leu, or Gly
  SITE (157)..(157): Xaa at position 157 is Ile, Ala, Val, Leu, or Gly
  SITE (158)..(158): Xaa at position 158 is Leu, Ala, Val, Gly, or Ile
  SITE (159)..(159): Xaa at position 159 is Val, Ala, Gly, Leu, or Ile
  SITE (175)..(175): Xaa at position 175 is Leu, Ala, Val, Gly, or Ile
  SITE (183)..(183): Xaa at position 183 is Val, Ala, Gly, Leu, or Ile
  SITE (188)..(188): Xaa at position 188 is Ala, Gly, or Pro
  SITE (190)..(190): Xaa at position 190 is Leu, Ala, Val, Gly, or Ile
  SITE (191)..(191): Xaa at position 191 is Cys, Ala, Val, Gly, Ser, or Thr
  SITE (192)..(192): Xaa at position 192 is Ala, Gly, or Pro
  SITE (195)..(195): Xaa at position 195 is Ile, Ala, Val, Leu, or Gly
  SITE (203)..(203): Xaa at position 203 is Cys, Ala, Val, Gly, Ser, or Thr
  SITE (211)..(211): Xaa at position 211 is Leu, Ala, Val, Gly, or Ile
  SITE (214)..(214): Xaa at position 214 is Val, Ala, Gly, Leu, or Ile
  SITE (215)..(215): Xaa at position 215 is Phe, Tyr, Met, His, Ile, Leu, Val Ala, or Gly
  SITE (217)..(217): Xaa at position 217 is Ala, Gly, or Pro
  SITE (218)..(218): Xaa at position 218 is Ala, Gly, or Pro
  SITE (219)..(219): Xaa at position 219 is Ile, Ala, Val, Leu, or Gly
MPPQQGDPAFPDRCEAPPVPPRRERGGRGGRGPGEPGGRGRAGGAEGRGXKXXXXGDGAXGKTSXXVSYTTNGXPTEYIPTXFDNFSAVXSXDGRPXRXQXCDTXGQDEFDKLRPLCXTNTDXXXXXXSXVSPSSXQNXSEKXXPEXRCHXPKAPXXXXGTQSDLREDVKVLIEXDKCKEKPXPEEAXKXXXEEXKAASYIEXSALTQKNXKEXXDXXXVAGIQYSDTQQQPKKSKSRTPDKMKNLSKSWWKKYCCFV

SEQ ID NO: 774 - protein, 351 aa, Homo sapiens
  SITE (34)..(34): Xaa at position 34 is Leu, Ala, Val, Gly, or Ile
  SITE (52)..(52): Xaa at position 52 is Ile, Ala, Val, Leu, or Gly
  SITE (66)..(66): Xaa at position 66 is Ala, Gly, or Pro
  SITE (78)..(78): Xaa at position 78 is Trp, Tyr, Phe, Met, His, Ile, Leu Val, Ala, or Gly
  SITE (88)..(88): Xaa at position 88 is Phe, Tyr, Met, His, Ile, Leu, Val Ala, or Gly
  SITE (89)..(89): Xaa at position 89 is Ile, Ala, Val, Leu, or Gly
  SITE (92)..(92): Xaa at position 92 is Ile, Ala, Val, Leu, or Gly
  SITE (93)..(93): Xaa at position 93 is Leu, Ala, Val, Gly, or Ile
  SITE (94)..(94): Xaa at position 94 is Ala, Gly, or Pro
  SITE (95)..(95): Xaa at position 95 is Phe, Tyr, Met, His, Ile, Leu, Val Ala, or Gly
  SITE (96)..(96): Xaa at position 96 is Phe, Tyr, Met, His, Ile, Leu, Val Ala, or Gly
  SITE (111)..(111): Xaa at position 111 is Phe, Tyr, Met, His, Ile, Leu, Val Ala, or Gly
  SITE (115)..(115): Xaa at position 115 is Val, Ala, Gly, Leu, or Ile
  SITE (117)..(117): Xaa at position 117 is Val, Ala, Gly, Leu, or Ile
  SITE (120)..(120): Xaa at position 120 is Ala, Gly, or Pro
  SITE (123)..(123): Xaa at position 123 is Phe, Tyr, Met, His, Ile, Leu, Val Ala, or Gly
  SITE (124)..(124): Xaa at position 124 is Tyr, Phe, Met, His, Ile, Leu, Val Ala, or Gly
  SITE (134)..(134): Xaa at position 134 is His, Phe, Tyr, Lys, Arg, Gly, Ser Thr, Ala, Val, Leu, Ile, Asn, Met, or Gln
  SITE (137)..(137): Xaa at position 137 is Met, Ile, Leu, Val, Ala, or Gly
  SITE (141)..(141): Xaa at position 141 is Leu, Ala, Val, Gly, or Ile
  SITE (142)..(142): Xaa at position 142 is Ile, Ala, Val, Leu, or Gly
  SITE (145)..(145): Xaa at position 145 is Tyr, Phe, Met, His, Ile, Leu, Val Ala, or Gly
  SITE (146)..(146): Xaa at position 146 is Ile, Ala, Val, Leu, or Gly
  SITE (158)..(158): Xaa at position 158 is Ala, Gly, or Pro
  SITE (159)..(159): Xaa at position 159 is Ile, Ala, Val, Leu, or Gly
  SITE (164)..(164): Xaa at position 164 is Tyr, Phe, Met, His, Ile, Leu, Val Ala, or Gly
  SITE (169)..(169): Xaa at position 169 is Ala, Gly, or Pro
  SITE (171)..(171): Xaa at position 171 is Trp, Tyr, Phe, Met, His, Ile, Leu Val, Ala, or Gly
  SITE (187)..(187): Xaa at position 187 is Val, Ala, Gly, Leu, or Ile
  SITE (188)..(188): Xaa at position 188 is Val, Ala, Gly, Leu, or Ile
  SITE (189)..(189): Xaa at position 189 is Ala, Gly, or Pro
  SITE (191)..(191): Xaa at position 191 is Ala, Gly, or Pro
  SITE (192)..(192): Xaa at position 192 is Ala, Gly, or Pro
  SITE (196)..(196): Xaa at position 196 is Val, Ala, Gly, Leu, or Ile
  SITE (197)..(197): Xaa at position 197 is Phe, Tyr, Met, His, Ile, Leu, Val Ala, or Gly
  SITE (198)..(198): Xaa at position 198 is Phe, Tyr, Met, His, Ile, Leu, Val Ala, or Gly
  SITE (203)..(203): Xaa at position 203 is Ala, Gly, or Pro
  SITE (204)..(204): Xaa at position 204 is Ala, Gly, or Pro
  SITE (205)..(205): Xaa at position 205 is Ile, Ala, Val, Leu, or Gly
  SITE (208)..(208): Xaa at position 208 is Leu, Ala, Val, Gly, or Ile
  SITE (213)..(213): Xaa at position 213 is Leu, Ala, Val, Gly, or Ile
  SITE (214)..(214): Xaa at position 214 is Met, Ile, Leu, Val, Ala, or Gly
  SITE (217)..(217): Xaa at position 217 is Leu, Ala, Val, Gly, or Ile
  SITE (224)..(224): Xaa at position 224 is Ile, Ala, Val, Leu, or Gly
  SITE (234)..(234): Xaa at position 234 is Phe, Tyr, Met, His, Ile, Leu, Val Ala, or Gly
  SITE (235)..(235): Xaa at position 235 is Ala, Gly, or Pro
  SITE (236)..(236): Xaa at position 236 is Cys, Ala, Val, Gly, Ser, or Thr
  SITE (238)..(238): Xaa at position 238 is Met, Ile, Leu, Val, Ala, or Gly
  SITE (239)..(239): Xaa at position 239 is Phe, Tyr, Met, His, Ile, Leu, Val Ala, or Gly
  SITE (251)..(251): Xaa at position 251 is Val, Ala, Gly, Leu, or Ile
  SITE (254)..(254): Xaa at position 254 is Ile, Ala, Val, Leu, or Gly
  SITE (255)..(255): Xaa at position 255 is Ile, Ala, Val, Leu, or Gly
  SITE (258)..(258): Xaa at position 258 is Ala, Gly, or Pro
  SITE (259)..(259): Xaa at position 259 is Val, Ala, Gly, Leu, or Ile
  SITE (265)..(265): Xaa at position 265 is Phe, Tyr, Met, His, Ile, Leu, Val Ala, or Gly
  SITE (266)..(266): Xaa at position 266 is Leu, Ala, Val, Gly, or Ile
  SITE (269)..(269): Xaa at position 269 is Ala, Gly, or Pro
  SITE (270)..(270): Xaa at position 270 is Leu, Ala, Val, Gly, or Ile
  SITE (272)..(272): Xaa at position 272 is Val, Ala, Gly, Leu, or Ile
  SITE (274)..(274): Xaa at position 274 is Leu, Ala, Val, Gly, or Ile
  SITE (275)..(275): Xaa at position 275 is Ile, Ala, Val, Leu, or Gly
  SITE (282)..(282): Xaa at position 282 is Met, Ile, Leu, Val, Ala, or Gly
  SITE (286)..(286): Xaa at position 286 is Ile, Ala, Val, Leu, or Gly
  SITE (290)..(290): Xaa at position 290 is Ala, Gly, or Pro
  SITE (294)..(294): Xaa at position 294 is Leu, Ala, Val, Gly, or Ile
  SITE (303)..(303): Xaa at position 303 is Phe, Tyr, Met, His, Ile, Leu, Val Ala, or Gly
MGDPERPEAAGLDQDERSSSDTNESEIKSNEEPXLRKSSRRFVIFPIQYPDXWKMYKQAQASFWTXEEVDLSKDLPHXNKLKADEKYXXSHXXXXXAASDGIVNENLVERXSQEXQXPEXRCXXGFQILIENVXSEXYSLXXDTXXRDPKKREFLFNXXETMPXVKKKXDXALRWIADRKSTFGERXXXFXXVEGXXXSGSFXXXFWXKKRGXXPGXTFSNELXSRDEGLHCDXXXLXXQYLVNKPSEERXREXXVDXXKIEQEXXTEXXPXGXXGMNCILXKQYXEFVXDRLXVELGFSKVXQAENPFDFMENISLEGKTNFFEKRVSEYQRFAVMAETTDNVFTLDADF

SEQ ID NO: 775 - protein, 1248 aa, Homo sapiens
  SITE (815)..(815): Xaa at position 815 is Val, Ala, Gly, Leu, or Ile
  SITE (818)..(818): Xaa at position 818 is Trp, Tyr, Phe, Met, His, Ile, Leu Val, Ala, or Gly
  SITE (819)..(819): Xaa at position 819 is Leu, Ala, Val, Gly, or Ile
  SITE (831)..(831): Xaa at position 831 is Leu, Ala, Val, Gly, or Ile
  SITE (836)..(836): Xaa at position 836 is Phe, Tyr, Met, His, Ile, Leu, Val Ala, or Gly
  SITE (842)..(842): Xaa at position 842 is Met, Ile, Leu, Val, Ala, or Gly
  SITE (847)..(847): Xaa at position 847 is Met, Ile, Leu, Val, Ala, or Gly
  SITE (852)..(852): Xaa at position 852 is Leu, Ala, Val, Gly, or Ile
  SITE (857)..(857): Xaa at position 857 is Ile, Ala, Val, Leu, or Gly
  SITE (866)..(866): Xaa at position 866 is Ile, Ala, Val, Leu, or Gly
  SITE (869)..(869): Xaa at position 869 is Ala, Gly, or Pro
  SITE (870)..(870): Xaa at position 870 is Ile, Ala, Val, Leu, or Gly
  SITE (889)..(889): Xaa at position 889 is Val, Ala, Gly, Leu, or Ile
  SITE (893)..(893): Xaa at position 893 is Leu, Ala, Val, Gly, or Ile
  SITE (905)..(905): Xaa at position 905 is Phe, Tyr, Met, His, Ile, Leu, Val Ala, or Gly
  SITE (933)..(933): Xaa at position 933 is Ile, Ala, Val, Leu, or Gly
  SITE (939)..(939): Xaa at position 939 is Ile, Ala, Val, Leu, or Gly
  SITE (1064)..(1064): Xaa at position 1064 is Ala, Gly, or Pro
  SITE (1065)..(1065): Xaa at position 1065 is Phe, Tyr, Met, His, Ile, Leu Val, Ala, or Gly
  SITE (1084)..(1084): Xaa at position 1084 is Ala, Gly, or Pro
  SITE (1085)..(1085): Xaa at position 1085 is Cys, Ala, Val, Gly, Ser, or Thr
  SITE (1105)..(1105): Xaa at position 1105 is Ile, Ala, Val, Leu, or Gly
  SITE (1107)..(1107): Xaa at position 1107 is Leu, Ala, Val, Gly, or Ile
  SITE (1109)..(1109): Xaa at position 1109 is Val, Ala, Gly, Leu, or Ile
  SITE (1114)..(1114): Xaa at position 1114 is Val, Ala, Gly, Leu, or Ile
  SITE (1130)..(1130): Xaa at position 1130 is Ile, Ala, Val, Leu, or Gly
  SITE (1133)..(1133): Xaa at position 1133 is Ile, Ala, Val, Leu, or Gly
  SITE (1146)..(1146): Xaa at position 1146 is Phe, Tyr, Met, His, Ile, Leu Val, Ala, or Gly
  SITE (1147)..(1147): Xaa at position 1147 is Ala, Gly, or Pro
  SITE (1148)..(1148): Xaa at position 1148 is Tyr, Phe, Met, His, Ile, Leu Val, Ala, or Gly
  SITE (1149)..(1149): Xaa at position 1149 is Ile, Ala, Val, Leu, or Gly
  SITE (1160)..(1160): Xaa at position 1160 is Cys, Ala, Val, Gly, Ser, or Thr
  SITE (1162)..(1162): Xaa at position 1162 is Val, Ala, Gly, Leu, or Ile
  SITE (1163)..(1163): Xaa at position 1163 is Phe, Tyr, Met, His, Ile, Leu Val, Ala, or Gly
  SITE (1171)..(1171): Xaa at position 1171 is Ala, Gly, or Pro
  SITE (1174)..(1174): Xaa at position 1174 is Ile, Ala, Val, Leu, or Gly
  SITE (1178)..(1178): Xaa at position 1178 is Leu, Ala, Val, Gly, or Ile
  SITE (1181)..(1181): Xaa at position 1181 is Ala, Gly, or Pro
MGKDQELLEAARTGNVALVEKLLSGRKGGILGGGSGPLPLSNLLSIWRGPNVNCTDSSGYTALHHAALNGHKDIVLKLLQYEASTNVADNKGYFPIHLAAWKGDVEIVKILIHHGPSHSRVNEQNNENETALHCAAQYGHSEVVAVLLEELTDPTIRNSKLETPLDLAALYGRLRVVKMIISAHPNLMSCNTRKHTPLHLAARNGHKAVVQVLLEAGMDVSCQTEKGSALHEAALFGKVDVVRVLLETGIDANIKDSLGRTVLDILKEHPSQKSLQIATLLQEYLEGVGRSTVLEEPVQEDATQETHISSPVESPSQKTKSETVTGELSKLLDEIKLCQEKDYSFEDLCHTISDHYLDNLSKISEEELGKNGSQSVRTSSTINLSPGEVEEEDDDENTCGPSGLWEALTPCNGCRNLGFPMLAQESYPKKRNYTMEIVPSASLDTFPSENENFLCDLMDTAVTKKPCSLEIARAPSPRTDNASEVAVTTPGTSNHRNSSTGPTPDCSPPSPDTALKNIVKVIRPQPKQRTSIVSSLDFHRMNHNQEYFEINTSTGCTSFTASPPASPPTSSVGTTEVKNEGTNHTDDLSRQDDNDPPKEYDPGQFAGLLHGSSPACESPENPFHLYGKREQCEKGQDEVSLANSPLPFKQSPIENNSEPLVKKIKPKVVSRTIFHKKSNQLENHTIVGTRSTRSGSRNGDQWVMNAGGFVERACTLGRIRSLPKALIDMHLSKSVSKSDSDLIAYPSNEKTSRVNWSESSTAEHSSKGNSERTPSFTSEWEEIDKIMSSIDVGINNELKEMNGETTRPRCPVQTXGQXXESIGLPQYENHXMANGXDNVQFXGSNVXEDQDXLEIGXLNSGHRQRXLQXXQLLPKMRPIGHDGYHPTSXAEWXDSIELGDYTKAXLINGYTSMDLLKKIWEVELINVLKINLXGHRKRXLASLGDRLHDDPPQKPPRSITLREPSGNHTPPQLSPSLSQSTYTTGGSLDVPHIIMQGDARRRRNENYFDDIPRSKLERQMAQTGDWGEPSITLRPPNEATASTPVQYWQHHPEKLIFQSCDYKXXYLGSMLIKELRGTESTQDXXAKMRANCQKSTEQMKKVPTXIXSXSYKGXKFIDATNKNIIAEHEXRNXSCAAQDPEDLSTXXXXTKDLKSNHHYXHXXTAFDVNLXYEXILTXGQXFEVAYQLALQARKGGHSSTLPESFENKPSKPIPKPRVSIRKSVDLLHASHTGQEPSERHTEEALRKF

SEQ ID NO: 776 - protein, 4374 aa, Homo sapiens
  SITE (1335)..(1335): Xaa at position 1335 is Ala, Gly, or Pro
  SITE (1338)..(1338): Xaa at position 1338 is Ala, Gly, or Pro
  SITE (1348)..(1348): Xaa at position 1348 is Ala, Gly, or Pro
  SITE (1352)..(1352): Xaa at position 1352 is Leu, Ala, Val, Gly, or Ile
  SITE (4001)..(4001): Xaa at position 4001 is Phe, Tyr, Met, His, Ile, Leu Val, Ala, or Gly
  SITE (4019)..(4019): Xaa at position 4019 is Val, Ala, Gly, Leu, or Ile
  SITE (4021)..(4021): Xaa at position 4021 is Val, Ala, Gly, Leu, or Ile
  SITE (4026)..(4026): Xaa at position 4026 is Val, Ala, Gly, Leu, or Ile
  SITE (4027)..(4027): Xaa at position 4027 is Phe, Tyr, Met, His, Ile, Leu Val, Ala, or Gly
  SITE (4034)..(4034): Xaa at position 4034 is Leu, Ala, Val, Gly, or Ile
  SITE (4042)..(4042): Xaa at position 4042 is Met, Ile, Leu, Val, Ala, or Gly
  SITE (4065)..(4065): Xaa at position 4065 is Trp, Tyr, Phe, Met, His, Ile Leu, Val, Ala, or Gly
  SITE (4066)..(4066): Xaa at position 4066 is Tyr, Phe, Met, His, Ile, Leu Val, Ala, or Gly
  SITE (4069)..(4069): Xaa at position 4069 is Ile, Ala, Val, Leu, or Gly
  SITE (4073)..(4073): Xaa at position 4073 is Met, Ile, Leu, Val, Ala, or Gly
  SITE (4080)..(4080): Xaa at position 4080 is Leu, Ala, Val, Gly, or Ile
  SITE (4093)..(4093): Xaa at position 4093 is Ile, Ala, Val, Leu, or Gly
  SITE (4107)..(4107): Xaa at position 4107 is Phe, Tyr, Met, His, Ile, Leu Val, Ala, or Gly
  SITE (4109)..(4109): Xaa at position 4109 is Phe, Tyr, Met, His, Ile, Leu Val, Ala, or Gly
  SITE (4110)..(4110): Xaa at position 4110 is Val, Ala, Gly, Leu, or Ile
  SITE (4113)..(4113): Xaa at position 4113 is Ile, Ala, Val, Leu, or Gly
  SITE (4114)..(4114): Xaa at position 4114 is Val, Ala, Gly, Leu, or Ile
  SITE (4115)..(4115): Xaa at position 4115 is Ala, Gly, or Pro
  SITE (4117)..(4117): Xaa at position 4117 is Ala, Gly, or Pro
  SITE (4124)..(4124): Xaa at position 4124 is Leu, Ala, Val, Gly, or Ile
  SITE (4126)..(4126): Xaa at position 4126 is Cys, Ala, Val, Gly, Ser, or Thr
  SITE (4128)..(4128): Xaa at position 4128 is Phe, Tyr, Met, His, Ile, Leu Val, Ala, or Gly
  SITE (4132)..(4132): Xaa at position 4132 is Phe, Tyr, Met, His, Ile, Leu Val, Ala, or Gly
  SITE (4133)..(4133): Xaa at position 4133 is Tyr, Phe, Met, His, Ile, Leu Val, Ala, or Gly
  SITE (4136)..(4136): Xaa at position 4136 is Ile, Ala, Val, Leu, or Gly
  SITE (4146)..(4146): Xaa at position 4146 is Met, Ile, Leu, Val, Ala, or Gly
  SITE (4174)..(4174): Xaa at position 4174 is Phe, Tyr, Met, His, Ile, Leu Val, Ala, or Gly
  SITE (4207)..(4207): Xaa at position 4207 is Val, Ala, Gly, Leu, or Ile
  SITE (4210)..(4210): Xaa at position 4210 is Val, Ala, Gly, Leu, or Ile
  SITE (4211)..(4211): Xaa at position 4211 is Cys, Ala, Val, Gly, Ser, or Thr
  SITE (4215)..(4215): Xaa at position 4215 is Met, Ile, Leu, Val, Ala, or Gly
  SITE (4226)..(4226): Xaa at position 4226 is Phe, Tyr, Met, His, Ile, Leu Val, Ala, or Gly
  SITE (4230)..(4230): Xaa at position 4230 is Phe, Tyr, Met, His, Ile, Leu Val, Ala, or Gly
  SITE (4234)..(4234): Xaa at position 4234 is Ile, Ala, Val, Leu, or Gly
  SITE (4238)..(4238): Xaa at position 4238 is Leu, Ala, Val, Gly, or Ile
  SITE (4239)..(4239): Xaa at position 4239 is Ile, Ala, Val, Leu, or Gly
  SITE (4241)..(4241): Xaa at position 4241 is Ile, Ala, Val, Leu, or Gly
  SITE (4247)..(4247): Xaa at position 4247 is Leu, Ala, Val, Gly, or Ile
  SITE (4251)..(4251): Xaa at position 4251 is Ile, Ala, Val, Leu, or Gly
  SITE (4278)..(4278): Xaa at position 4278 is Ile, Ala, Val, Leu, or Gly
  SITE (4281)..(4281): Xaa at position 4281 is Phe, Tyr, Met, His, Ile, Leu Val, Ala, or Gly
  SITE (4284)..(4284): Xaa at position 4284 is Ala, Gly, or Pro
  SITE (4285)..(4285): Xaa at position 4285 is Leu, Ala, Val, Gly, or Ile
  SITE (4294)..(4294): Xaa at position 4294 is Ala, Gly, or Pro
  SITE (4300)..(4300): Xaa at position 4300 is Val, Ala, Gly, Leu, or Ile
  SITE (4311)..(4311): Xaa at position 4311 is Phe, Tyr, Met, His, Ile, Leu Val, Ala, or Gly
  SITE (4323)..(4323): Xaa at position 4323 is Phe, Tyr, Met, His, Ile, Leu Val, Ala, or Gly
  SITE (4325)..(4325): Xaa at position 4325 is Ile, Ala, Val, Leu, or Gly
  SITE (4341)..(4341): Xaa at position 4341 is Cys, Ala, Val, Gly, Ser, or Thr
  SITE (4345)..(4345): Xaa at position 4345 is Leu, Ala, Val, Gly, or Ile
  SITE (4347)..(4347): Xaa at position 4347 is Leu, Ala, Val, Gly, or Ile
  SITE (4350)..(4350): Xaa at position 4350 is Tyr, Phe, Met, His, Ile, Leu Val, Ala, or Gly
  SITE (4356)..(4356): Xaa at position 4356 is Leu, Ala, Val, Gly, or Ile
  SITE (4360)..(4360): Xaa at position 4360 is Leu, Ala, Val, Gly, or Ile
  SITE (4363)..(4363): Xaa at position 4363 is Ala, Gly, or Pro
  SITE (4364)..(4364): Xaa at position 4364 is Ile, Ala, Val, Leu, or Gly
MKVDRTKLKKTPTEAPADCRALIDKLKVCNDEQLLLELQQIKTWNIGKCELYHWVDLLDRFDGILADAGQTVENMSWMLVCDRPEREQLKMLLLAVLNFTALLIEYSFSRHLYSSIEHLTTLLASSDMQVVLAVLNLLYVFSKRSNYITRLGSDKRTPLLTRLQHLAESWGGKENGFGLAECCRDLHMMKYPPSATTLHFEFYADPGAEVKIEKRTTSNTLHYIHIEQLDKISESPSEIMESLTKMYSIPKDKQMLLFTHIRLAHGFSNHRKRLQAVQARLHAISILVYSNALQESANSILYNGLIEELVDVLQITDKQLMEIKAASLRTLTSIVHLERTPKLSSIIDCTGTASYHGFLPVLVRNCIQAMIDPSMDPYPHQFATALFSFLYHLASYDAGGEALVSCGMMEALLKVIKFLGDEQDQITFVTRAVRVVDLITNLDMAAFQSHSGLSIFIYRLEHEVDLCRKECPFVIKPKIQRPNTTQEGEEMETDMDGVQCIPQRAALLKSMLNFLKKAIQDPAFSDGIRHVMDGSLPTSLKHIISNAEYYGPSLFLLATEVVTVFVFQEPSLLSSLQDNGLTDVMLHALLIKDVPATREVLGSLPNVFSALCLNARGLQSFVQCQPFERLFKVLLSPDYLPAMRRRRSSDPLGDTASNLGSAVDELMRHQPTLKTDATTAIIKLLEEICNLGRDPKYICQKPSIQKADGTATAPPPRSNHAAEEASSEDEEEEEVQAMQSFNSTQQNETEPNQQVVGTEERIPIPLMDYILNVMKFVESILSNNTTDDHCQEFVNQKGLLPLVTILGLPNLPIDFPTSAACQAVAGVCKSILTLSHEPKVLQEGLLQLDSILSSLEPLHRPIESPGGSVLLRELACAGNVADATLSAQATPLLHALTAAHAYIMMFVHTCRVGQSEIRSISVNQWGSQLGLSVLSKLSQLYCSLVWESTVLLSLCTPNSLPSGCEFGQADMQKLVPKDEKAGTTQGGKRSDGEQDGAAGSMDASTQGLLEGIGLDGDTLAPMETDEPTASDSKGKSKITPAMAARIKQIKPLLSASSRLGRALAELFGLLVKLCVGSPVRQRRSHHAASTTTAPTPAARSTASALTKLLTKGLSWQPPPYTPTPRFRLTFFICSVGFTSPMLFDERKYPYHLMLQKFLCSGGHNALFETFNWALSMGGKVPVSEGLEHSDLPDGTGEFLDAWLMLVEKMVNPTTVLESPHSLPAKLPGGVQNFPQFSALRFLVVTQKAAFTCIKNLWNRKPLKVYGGRMAESMLAILCHILRGEPVIRERLSKEKEGSRGEEDTGQEEGGSRREPQVNQQQLQQLMDMGFTREHXMEXLLNTSTMEQXTEYXLTHPPPIMGGVVRDLSMSEEDQMMRAIAMSLGQDIPMDQRAESPEEVACRKEEEERKAREKQEEEEAKCLEKFQDADPLEQDELHTFTDTMLPGCFHLLDELPDTVYRVCDLIMTAIKRNGADYRDMILKQVVNQVWEAADVLIKAALPLTTSDTKTVSEWISQMATLPQASNLATRILLLTLLFEELKLPCAWVVESSGILNVLIKLLEVVQPCLQAAKEQKEVQTPKWITPVLLLIDFYEKTAISSKRRAQMTKYLQSNSNNWRWFDDRSGRWCSYSASNNSTIDSAWKSGETSVRFTAGRRRYTVQFTTMVQVNEETGNRRPVMLTLLRVPRLNKNSKNSNGQELEKTLEESKEMDIKRKENKGNDTPLALESTNTEKETSLEETKIGEILIQGLTEDMVTVLIRACVSMLGVPVDPDTLHATLRLCLRLTRDHKYAMMFAELKSTRMILNLTQSSGFNGFTPLVTLLLRHIIEDPCTLRHTMEKVVRSAATSGAGSTTSGVVSGSLGSREINYILRVLGPAACRNPDIFTEVANCCIRIALPAPRGSGTASDDEFENLRIKGPNAVQLVKTTPLKPSPLPVIPDTIKEVIYDMLNALAAYHAPEEADKSDPKPGVMTQEVGQLLQDMGDDVYQQYRSLTRQSSDFDTQSGFSINSQVFAADGASTETSASGTSQGEASTPEESRDGKKDKEGDRASEEGKQKGKGSKPLMPTSTILRLLAELVRSYVGIATLIANYSYTVGQSELIKEDCSVLAFVLDHLLPHTQNAEDKDTPALARLFLASLAAAGSGTDAQVALVNEVKAALGRALAMAESTEKHARLQAVMCIISTIMESCPSTSSFYSSATAKTQHNGMNNIIRLFLKKGLVNDLARVPHSLDLSSPNMANTVNAALKPLETLSRIVNQPSSLFGSKSASSKNKSEQDAQGASQDSSSNQQDPGEPGEAEVQEEDHDVTQTEVADGDIMDGEAETDSVVIAGQPEVLSSQEMQVENELEDLIDELLERDGGSGNSTIIVSRSGEDESQEDVLMDEAPSNLSQASTLQANREDSMNILDPEDEEEHTQEEDSSGSNEDEDDSQDEEEEEEEDEEDDQEDDEGEEGDEDDDDDGSEMELDEDYPDMNASPLVRFERFDREDDLIIEFDNMFSSATDIPPSPGNIPTTHPLMVRHADHSSLTLGSGSSTTRLTQGIGRSQRTLRQLTANTGHTIHVHYPGNRQPNPPLILQRLLGPSAAADILQLSSSLPLQSRGRARLLVGNDDVHIIARSDDELLDDFFHDQSTATSQAGTLSSIPTALTRWTEECKVLDAESMHDCVSVVKVSIVNHLEFLRDEELEERREKRRKQLAEEETKITDKGKEDKENRDQSAQCTASKSNDSTEQNLSDGTPMPDSYPTTPSSTDAATSESKETLGTLQSSQQQPTLPTPPALGEVPQELQSPAGEGGSSTQLLMPVEPEELGPTRPSGEAETTQMELSPAPTITSLSPERAEDSDALTAVSSQLEGSPMDTSSLASCTLEEAVGDTSAAGSSEQPRAGSSTPGDAPPAVAEVQGRSDGSGESAQPPEDSSPPASSESSSTRDSAVAISGADSRGILEEPLPSTSSEEEDPLAGISLPEGVDPSFLAALPDDIRREVLQNQLGIRPPTRTAPSTNSSAPAVVGNPGVTEVSPEFLAALPPAIQEEVLAQQRAEQQRRELAQNASSDTPMDPVTFIQTLPSDLRRSVLEDMEDSVLAVMPPDIAAEAQALRREQEARQRQLMHERLFGHSSTSALSAILRSPAFTSRLSGNRGVQYTRLAVQRGGTFQMGGSSSHNRPSGSNVDTLLRLRGRLLLDHEALSCLLVLLFVDEPKLNTSRLHRVLRNLCYHAQTRHWVIRSLLSILQRSSESELCIETPKLTTSEEKGKKSSKSCGSSSHENRPLDLLHKMESKSSNQLSWLSVSMDAALGCRTNIFQIQRSGGRKHTEKHASGGSTVHIHPQAAPVVCRHVLDTLIQLAKVFPSHFTQQRTKETNCESDRERGNKACSPCSSQSSSSGICTDFWDLLVKLDNMNVSRKGKNSVKSVPVSAGGEGETSPYSLEASPLGQLMNMLSHPVIRRSSLLTEKLLRLLSLISIALPENKVSEAQANSGSGASSTTTATSTTSTTTTTAASTTPTPPTAPTPVTSAPALVAATAISTIVVAASTTVTTPTTATTTVSISPTTKGSKSPAKVSDGGSSSTDFKMVSSGLTENQLQLSVEVLTSHSCSEEGLEDAANVLLQLSRGDSGTRDTVLKLLLNGARHLGYTLCKQIGTLLAELREYNLEQQRRAQCETLSPDGLPEEQPQTTKLKGKMQSRFDMAENVVIVASQKRPLGGRELQLPSMSMLTSKTSTQKFFLRVLQVIIQLRDDTRRANKKAKQTGRLGSSGLGSASSIQAAVRQLEAEADAIIQMVREGQRARRQQQAATSESSQSEASVRREESPMDVDQPSPSAQDTQSIASDGTPQGEKEKEERPPELPLLSEQLSLDELWDMLGECLKELEESHDQHAVLVLQPAVEAFFLVHATERESKPPVRDTRESQLAHIKDEPPPLSPAPLTPATPSSLDPFFSREPSSMHISSSLPPDTQKFLRFAETHRTVLNQILRQSTTHLADGPFAVLVDYIRVLDFDVKRKYXRQELERLDEGLRKEDMAXHXRRDHXXEDSYREXHRKSPEEXKNRLYIVFEGEEGQDAGGLLREXXMIXSREXFNPMYAXFRTSPGDRVTYTXNPSSHCNPNHLSYXKXXGRXXXKXVYDNRLXEXYXTRSXXKHXLGKSVRYTDXESEDYHFYQGLVYLLENDVSTLGYDLTXSTEVQEFGVCEVRDLKPNGANILVTEENKKEYXHLXXQMRXTGAIRKQLAAXLEGXYEIXPKRXXSXFTEQEXELLXSGLPTIDIDDLKSNTEYHKYQSNSIQXQWXWRXXRSFDQADRXKFLQFXTGTSKVPLQGXAALEGMNGIQKXQXHRDDRSTDRLPSAHTXFNQXDXPAXESFEKXRHMXLLXXQECSEGFGLA

SEQ ID NO: 777 - protein, 565 aa, Influenza A virus
  strain A/Equine/Kentucky/1/1981
  SITE (26)..(26): Xaa at position 26 is Ala, Gly, or Pro
  SITE (28)..(28): Xaa at position 28 is Leu, Ala, Val, Gly, or Ile
  SITE (29)..(29): Xaa at position 29 is Cys, Ala, Val, Gly, Ser, or Thr
  SITE (30)..(30): Xaa at position 30 is Leu, Ala, Val, Gly, or Ile
  SITE (34)..(34): Xaa at position 34 is Ala, Gly, or Pro
  SITE (41)..(41): Xaa at position 41 is Val, Ala, Gly, Leu, or Ile
  SITE (51)..(51): Xaa at position 51 is Val, Ala, Gly, Leu, or Ile
  SITE (57)..(57): Xaa at position 57 is Leu, Ala, Val, Gly, or Ile
  SITE (58)..(58): Xaa at position 58 is Val, Ala, Gly, Leu, or Ile
  SITE (66)..(66): Xaa at position 66 is Ile, Ala, Val, Leu, or Gly
  SITE (67)..(67): Xaa at position 67 is Cys, Ala, Val, Gly, Ser, or Thr
  SITE (73)..(73): Xaa at position 73 is Val, Ala, Gly, Leu, or Ile
  SITE (79)..(79): Xaa at position 79 is Cys, Ala, Val, Gly, Ser, or Thr
  SITE (81)..(81): Xaa at position 81 is Leu, Ala, Val, Gly, or Ile
  SITE (82)..(82): Xaa at position 82 is Ile, Ala, Val, Leu, or Gly
  SITE (85)..(85): Xaa at position 85 is Met, Ile, Leu, Val, Ala, or Gly
  SITE (86)..(86): Xaa at position 86 is Leu, Ala, Val, Gly, or Ile
  SITE (91)..(91): Xaa at position 91 is Cys, Ala, Val, Gly, Ser, or Thr
  SITE (94)..(94): Xaa at position 94 is Phe, Tyr, Met, His, Ile, Leu, Val Ala, or Gly
  SITE (101)..(101): Xaa at position 101 is Leu, Ala, Val, Gly, or Ile
  SITE (102)..(102): Xaa at position 102 is Phe, Tyr, Met, His, Ile, Leu, Val Ala, or Gly
  SITE (103)..(103): Xaa at position 103 is Ile, Ala, Val, Leu, or Gly
  SITE (109)..(109): Xaa at position 109 is Phe, Tyr, Met, His, Ile, Leu, Val Ala, or Gly
  SITE (112)..(112): Xaa at position 112 is Cys, Ala, Val, Gly, Ser, or Thr
  SITE (113)..(113): Xaa at position 113 is Tyr, Phe, Met, His, Ile, Leu, Val Ala, or Gly
  SITE (115)..(115): Xaa at position 115 is Tyr, Phe, Met, His, Ile, Leu, Val Ala, or Gly
  SITE (120)..(120): Xaa at position 120 is Tyr, Phe, Met, His, Ile, Leu, Val Ala, or Gly
  SITE (121)..(121): Xaa at position 121 is Ala, Gly, or Pro
  SITE (123)..(123): Xaa at position 123 is Leu, Ala, Val, Gly, or Ile
  SITE (127)..(127): Xaa at position 127 is Val, Ala, Gly, Leu, or Ile
  SITE (128)..(128): Xaa at position 128 is Ala, Gly, or Pro
  SITE (133)..(133): Xaa at position 133 is Leu, Ala, Val, Gly, or Ile
  SITE (140)..(140): Xaa at position 140 is Phe, Tyr, Met, His, Ile, Leu, Val Ala, or Gly
  SITE (153)..(153): Xaa at position 153 is Ala, Gly, or Pro
  SITE (154)..(154): Xaa at position 154 is Cys, Ala, Val, Gly, Ser, or Thr
  SITE (162)..(162): Xaa at position 162 is Phe, Tyr, Met, His, Ile, Leu, Val Ala, or Gly
  SITE (163)..(163): Xaa at position 163 is Phe, Tyr, Met, His, Ile, Leu, Val Ala, or Gly
  SITE (166)..(166): Xaa at position 166 is Leu, Ala, Val, Gly, or Ile
  SITE (169)..(169): Xaa at position 169 is Leu, Ala, Val, Gly, or Ile
  SITE (179)..(179): Xaa at position 179 is Leu, Ala, Val, Gly, or Ile
  SITE (193)..(193): Xaa at position 193 is Tyr, Phe, Met, His, Ile, Leu, Val Ala, or Gly
  SITE (195)..(195): Xaa at position 195 is Trp, Tyr, Phe, Met, His, Ile, Leu Val, Ala, or Gly
  SITE (197)..(197): Xaa at position 197 is Ile, Ala, Val, Leu, or Gly
  SITE (198)..(198): Xaa at position 198 is His, Phe, Tyr, Lys, Arg, Gly, Ser Thr, Ala, Val, Leu, Ile, Asn, Met, or Gln
  SITE (199)..(199): Xaa at position 199 is His, Phe, Tyr, Lys, Arg, Gly, Ser Thr, Ala, Val, Leu, Ile, Asn, Met, or Gln
  SITE (210)..(210): Xaa at position 210 is Tyr, Phe, Met, His, Ile, Leu, Val Ala, or Gly
  SITE (217)..(217): Xaa at position 217 is Val, Ala, Gly, Leu, or Ile
  SITE (219)..(219): Xaa at position 219 is Val, Ala, Gly, Leu, or Ile
  SITE (245)..(245): Xaa at position 245 is Ile, Ala, Val, Leu, or Gly
  SITE (247)..(247): Xaa at position 247 is Ile, Ala, Val, Leu, or Gly
  SITE (248)..(248): Xaa at position 248 is Tyr, Phe, Met, His, Ile, Leu, Val Ala, or Gly
  SITE (251)..(251): Xaa at position 251 is Ile, Ala, Val, Leu, or Gly
  SITE (252)..(252): Xaa at position 252 is Val, Ala, Gly, Leu, or Ile
  SITE (257)..(257): Xaa at position 257 is Ile, Ala, Val, Leu, or Gly
  SITE (258)..(258): Xaa at position 258 is Leu, Ala, Val, Gly, or Ile
  SITE (260)..(260): Xaa at position 260 is Ile, Ala, Val, Leu, or Gly
  SITE (266)..(266): Xaa at position 266 is Leu, Ala, Val, Gly, or Ile
  SITE (267)..(267): Xaa at position 267 is Val, Ala, Gly, Leu, or Ile
  SITE (268)..(268): Xaa at position 268 is Ala, Gly, or Pro
  SITE (273)..(273): Xaa at position 273 is Phe, Tyr, Met, His, Ile, Leu, Val Ala, or Gly
  SITE (289)..(289): Xaa at position 289 is Ile, Ala, Val, Leu, or Gly
  SITE (296)..(296): Xaa at position 296 is Cys, Ala, Val, Gly, Ser, or Thr
  SITE (297)..(297): Xaa at position 297 is Ile, Ala, Val, Leu, or Gly
  SITE (303)..(303): Xaa at position 303 is Ile, Ala, Val, Leu, or Gly
  SITE (324)..(324): Xaa at position 324 is Ile, Ala, Val, Leu, or Gly
  SITE (331)..(331): Xaa at position 331 is Leu, Ala, Val, Gly, or Ile
  SITE (332)..(332): Xaa at position 332 is Ala, Gly, or Pro
  SITE (349)..(349): Xaa at position 349 is Ala, Gly, or Pro
  SITE (358)..(358): Xaa at position 358 is Trp, Tyr, Phe, Met, His, Ile, Leu Val, Ala, or Gly
  SITE (366)..(366): Xaa at position 366 is Tyr, Phe, Met, His, Ile, Leu, Val Ala, or Gly
  SITE (388)..(388): Xaa at position 388 is Ala, Gly, or Pro
  SITE (440)..(440): Xaa at position 440 is Ala, Gly, or Pro
  SITE (462)..(462): Xaa at position 462 is Leu, Ala, Val, Gly, or Ile
  SITE (470)..(470): Xaa at position 470 is Leu, Ala, Val, Gly, or Ile
  SITE (481)..(481): Xaa at position 481 is Cys, Ala, Val, Gly, Ser, or Thr
  SITE (482)..(482): Xaa at position 482 is Phe, Tyr, Met, His, Ile, Leu, Val Ala, or Gly
  SITE (484)..(484): Xaa at position 484 is Ile, Ala, Val, Leu, or Gly
  SITE (486)..(486): Xaa at position 486 is His, Phe, Tyr, Lys, Arg, Gly, Ser Thr, Ala, Val, Leu, Ile, Asn, Met, or Gln
  SITE (488)..(488): Xaa at position 488 is Cys, Ala, Val, Gly, Ser, or Thr
  SITE (492)..(492): Xaa at position 492 is Cys, Ala, Val, Gly, Ser, or Thr
  SITE (493)..(493): Xaa at position 493 is Ile, Ala, Val, Leu, or Gly
  SITE (496)..(496): Xaa at position 496 is Ile, Ala, Val, Leu, or Gly
  SITE (510)..(510): Xaa at position 510 is Ala, Gly, or Pro
MKTTIILILLTHWVYSQNPTSGNNTXTXXXGHHXVANGTLXKTITDDQIEXTNATEXXQSTSIGKXXNNPYRXLDGRNXTXXDAXXGDPHXDVXQYENWDXXXERSSAXSNXXPXDIPDXXSXRSIXXSSGTXEFTAEGXTWTGVTQNGGSGXXRRGSADSXXSRXNWXTKSGNSYPTXNVTMPNNNNFDKLXIXGXXXPSTNNEQTKLXIQESGRXTXSTKRSQQTIIPNIGSRPWVRGQSGRXSXXWTXXKPGDXXMXNSNGNXXXPRGYXKMRTGKSSVMRSDAPXDTCVSEXXTPNGSXPNDKPFQNVNKVTYGKCPKYXKQNTLKXXTGMRNVPEKQIRGIFGXIAGFIENGXEGMVDGWXGFRYQNSEGTGQAADLKSTQAXIDQINGKLNRVIERTNEKFHQIEKEFSEVEGRIQDLEKYVEDTKIDLWSYNXELLVALENQHTIDLTDAEMNKXFEKTRRQXRENAEDMGGGXXKXYXKXDNAXXGSXRNGTYDHYIYRDEXLNNRFQIKGVELKSGYKDWILWISFAISCFLICVVLLGFIMWACQKGNIRCNICI

SEQ ID NO: 778 - protein, 574 aa, Human respiratory syncytial virus
  SITE (233)..(233): Xaa at position 233 is Ile, Ala, Val, Leu, or Gly
  SITE (237)..(237): Xaa at position 237 is Phe, Tyr, Met, His, Ile, Leu, Val Ala, or Gly
  SITE (247)..(247): Xaa at position 247 is Val, Ala, Gly, Leu, or Ile
  SITE (251)..(251): Xaa at position 251 is Met, Ile, Leu, Val, Ala, or Gly
  SITE (257)..(257): Xaa at position 257 is Leu, Ala, Val, Gly, or Ile
  SITE (261)..(261): Xaa at position 261 is Ile, Ala, Val, Leu, or Gly
  SITE (274)..(274): Xaa at position 274 is Met, Ile, Leu, Val, Ala, or Gly
  SITE (281)..(281): Xaa at position 281 is Val, Ala, Gly, Leu, or Ile
  SITE (342)..(342): Xaa at position 342 is Phe, Tyr, Met, His, Ile, Leu, Val Ala, or Gly
  SITE (349)..(349): Xaa at position 349 is Val, Ala, Gly, Leu, or Ile
  SITE (382)..(382): Xaa at position 382 is Cys, Ala, Val, Gly, Ser, or Thr
  SITE (412)..(412): Xaa at position 412 is Ala, Gly, or Pro
  SITE (414)..(414): Xaa at position 414 is Val, Ala, Gly, Leu, or Ile
  SITE (416)..(416): Xaa at position 416 is Cys, Ala, Val, Gly, Ser, or Thr
  SITE (422)..(422): Xaa at position 422 is Cys, Ala, Val, Gly, Ser, or Thr
  SITE (424)..(424): Xaa at position 424 is Ala, Gly, or Pro
  SITE (450)..(450): Xaa at position 450 is Val, Ala, Gly, Leu, or Ile
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEXTREXSVNAGVTTPXSTYXLTNSEXLSLXNDMPITNDQKKLXSNNVQIXRQQSYSIMSIIKEEVLAYVVQLPLYGVIDTPCWKLHTSPLCTTNTKEGSNICLTRTDRGWXCDNAGSXSFFPQAETCKVQSNRVFCDTMNSLTLPSEVNLXNVDIFNPKYDCKIMTSKTDVSSSVITSLGXIXSXYGKTKXTXSNKNRGIIKTFSNGCDYVSNKGVDTXSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 779 - protein, 1692 aa, Homo sapiens
  SITE (600)..(600): Xaa at position 600 is Val, Ala, Gly, Leu, or Ile
  SITE (602)..(602): Xaa at position 602 is Leu, Ala, Val, Gly, or Ile
  SITE (614)..(614): Xaa at position 614 is Ala, Gly, or Pro
  SITE (616)..(616): Xaa at position 616 is Leu, Ala, Val, Gly, or Ile
  SITE (618)..(618): Xaa at position 618 is Leu, Ala, Val, Gly, or Ile
  SITE (633)..(633): Xaa at position 633 is Ala, Gly, or Pro
  SITE (635)..(635): Xaa at position 635 is Ile, Ala, Val, Leu, or Gly
  SITE (644)..(644): Xaa at position 644 is Ala, Gly, or Pro
  SITE (650)..(650): Xaa at position 650 is Leu, Ala, Val, Gly, or Ile
  SITE (656)..(656): Xaa at position 656 is Val, Ala, Gly, Leu, or Ile
  SITE (659)..(659): Xaa at position 659 is Trp, Tyr, Phe, Met, His, Ile, Leu Val, Ala, or Gly
  SITE (664)..(664): Xaa at position 664 is Leu, Ala, Val, Gly, or Ile
  SITE (672)..(672): Xaa at position 672 is Val, Ala, Gly, Leu, or Ile
  SITE (676)..(676): Xaa at position 676 is Ile, Ala, Val, Leu, or Gly
  SITE (685)..(685): Xaa at position 685 is Val, Ala, Gly, Leu, or Ile
  SITE (687)..(687): Xaa at position 687 is Ile, Ala, Val, Leu, or Gly
  SITE (689)..(689): Xaa at position 689 is Val, Ala, Gly, Leu, or Ile
  SITE (746)..(746): Xaa at position 746 is Leu, Ala, Val, Gly, or Ile
  SITE (748)..(748): Xaa at position 748 is Val, Ala, Gly, Leu, or Ile
  SITE (750)..(750): Xaa at position 750 is Leu, Ala, Val, Gly, or Ile
  SITE (759)..(759): Xaa at position 759 is Leu, Ala, Val, Gly, or Ile
  SITE (761)..(761): Xaa at position 761 is Val, Ala, Gly, Leu, or Ile
  SITE (763)..(763): Xaa at position 763 is Val, Ala, Gly, Leu, or Ile
  SITE (766)..(766): Xaa at position 766 is Ala, Gly, or Pro
  SITE (782)..(782): Xaa at position 782 is Val, Ala, Gly, Leu, or Ile
  SITE (784)..(784): Xaa at position 784 is Met, Ile, Leu, Val, Ala, or Gly
  SITE (818)..(818): Xaa at position 818 is Val, Ala, Gly, Leu, or Ile
  SITE (823)..(823): Xaa at position 823 is Phe, Tyr, Met, His, Ile, Leu, Val Ala, or Gly
  SITE (828)..(828): Xaa at position 828 is Leu, Ala, Val, Gly, or Ile
  SITE (830)..(830): Xaa at position 830 is Ile, Ala, Val, Leu, or Gly
  SITE (832)..(832): Xaa at position 832 is Val, Ala, Gly, Leu, or Ile
  SITE (846)..(846): Xaa at position 846 is Leu, Ala, Val, Gly, or Ile
  SITE (849)..(849): Xaa at position 849 is Ile, Ala, Val, Leu, or Gly
  SITE (853)..(853): Xaa at position 853 is Leu, Ala, Val, Gly, or Ile
MSSAVGPRGPRPPTVPPPMQELPDLSHLTEEERNIIMAVMDRQKEEEEKEEAMLKCVVRDMAKPAACKTPRNAENQPHQPSPRLHQQFESYKEQVRKIGEEARRYQGEHKDDAPTCGICHKTKFADGCGHLCSYCRTKFCARCGGRVSLRSNNEDKVVMWVCNLCRKQQEILTKSGAWFFGSGPQQTSQDGTLSDTATGAGSEVPREKKARLQERSRSQTPLSTAAASSQDAAPPSAPPDRSKGAEPSQQALGPEQKQASSRSRSEPPRERKKTPGLSEQNGKGALKSERKRVPKTSAQPVEGAVEERERKERRESRRLEKGRSQDYPDTPEKRDEGKAADEEKQRKEEDYQTRYRSDPNLARYPVKPPPEEQQMRMHARVSRARHERRHSDVALPRTEAGAALPEGKAGKRAPAAARASPPDSPRAYSAERTAETRAPGAKQLTNHSPPAPRHGPVPAEAPELKAQEPLRKQSRLDPSSAVLMRKAKREKVETMLRNDSLSSDQSESVRPSPPKPHRSKRGGKKRQMSVSSSEEEGVSTPEYTSCEDVELESESVSEKGDLDYYWLDPATWHSRETSPISSHPVTWQPSKEGDRLIGRXIXNKRTTMPKDSGXLXGXKVVGGKMTDLGRLGXFXTKVKKGSLXDVVGHXRAGDEXLEXNGKPXPGATNEEXYNIXLESKSEPQXEXIXSRPIGDIPRIPESSHPPLESSSSSFESQKMERPSISVISPTSPGALKDAPQVLPGQXSXKXWYDKVGHQXIXNXLQXTDLPARVDGRPRNPYXKXYFLPDRSDKSKRRTKTVKKILEPKWNQTFVYSHXHRRDXRERMXEXTXWDQPRVQEEESEFXGEXLIEXETALLDDEPHWYKLQTHDESSLPLPQPSPFMPRRHIHGESSSKKLQRSQRISDSDISDYEVDDGIGVVPPVGYRSSARESKSTTLTVPEQQRTTHHRSRSVSPHRGNDQGKPRSRLPNVPLQRSLDEIHPTRRSRSPTRHHDASRSPVDHRTRDVDSQYLSEQDSELLMLPRAKRGRSAECLHTTRHLVRHYKTLPPKMPLLQSSSHWNIYSSILPAHTKTKSVTRQDISLHHECFNSTVLRFTDEILVSELQPFLDRARSASTNCLRPDTSLHSPERERGRWSPSLDRRRPPSPRIQIQHASPENDRHSRKSERSSIQKQTRKGTASDAERVLPTCLSRRGHAAPRATDQPVIRGKHPARSRSSEHSSIRTLCSMHHLVPGGSAPPSPLLTRMHRQRSPTQSPPADTSFSSRRGRQLPQVPVRSGSIEQASLVVEERTRQMKMKVHRFKQTTGSGSSQELDREQYSKYNIHKDQYRSCDNVSAKSSDSDVSDVSAISRTSSASRLSSTSFMSEQSERPRGRISSFTPKMQGRRMGTSGRSIMKSTSVSGEMYTLEHNDGSQSDTAVGTVGAGGKKRRSSLSAKVVAIVSRRSRSTSQLSQTESGHKKLKSTIQRSTETGMAAEMRKMVRQPSRESTDGSINSYSSEGNLIFPGVRLGADSQFSDFLDGLGPAQLVGRQTLATPAMGDIQIGMEDKKGQLEVEVIRARSLTQKPGSKSTPAPYVKVYLLENGACIAKKKTRIARKTLDPLYQQSLVFDESPQGKVLQVIVWGDYGRMDHKCFMGVAQILLEELDLSSMVIGWYKLFPPSSLVDPTLTPLTRRASQSSLESSTGPPCIRS

SEQ ID NO: 780 - protein, 667 aa, Homo sapiens
  SITE (73)..(73): Xaa at position 73 is Leu, Ala, Val, Gly, or Ile
  SITE (74)..(74): Xaa at position 74 is Leu, Ala, Val, Gly, or Ile
  SITE (358)..(358): Xaa at position 358 is Ile, Ala, Val, Leu, or Gly
  SITE (378)..(378): Xaa at position 378 is Val, Ala, Gly, Leu, or Ile
  SITE (380)..(380): Xaa at position 380 is Phe, Tyr, Met, His, Ile, Leu, Val Ala, or Gly
  SITE (404)..(404): Xaa at position 404 is Leu, Ala, Val, Gly, or Ile
  SITE (422)..(422): Xaa at position 422 is Ile, Ala, Val, Leu, or Gly
  SITE (426)..(426): Xaa at position 426 is Val, Ala, Gly, Leu, or Ile
  SITE (437)..(437): Xaa at position 437 is Leu, Ala, Val, Gly, or Ile
  SITE (439)..(439): Xaa at position 439 is Cys, Ala, Val, Gly, Ser, or Thr
  SITE (446)..(446): Xaa at position 446 is Ala, Gly, or Pro
  SITE (448)..(448): Xaa at position 448 is Trp, Tyr, Phe, Met, His, Ile, Leu Val, Ala, or Gly
  SITE (449)..(449): Xaa at position 449 is Met, Ile, Leu, Val, Ala, or Gly
  SITE (450)..(450): Xaa at position 450 is Ala, Gly, or Pro
  SITE (452)..(452): Xaa at position 452 is Cys, Ala, Val, Gly, Ser, or Thr
  SITE (454)..(454): Xaa at position 454 is Leu, Ala, Val, Gly, or Ile
  SITE (455)..(455): Xaa at position 455 is Ala, Gly, or Pro
MAGMKTASGDYIDSSWELRVFVGEEDPEAESVTLRVTGESHIGGVLLKIVEQINRKQDWSDHAIWWEQKRQWXXQTHWTLDKYGILADARLFFGPQHRPVILRLPNRRALRLRASFSQPLFQAVAAICRLLSIRHPEELSLLRAPEKKEKKKKEKEPEEELYDLSKVVLAGGVAPALFRGMPAHFSDSAQTEACYHMLSRPQPPPDPLLLQRLPRPSSLSDKTQLHSRWLDSSRCLMQQGIKAGDALWLRFKYYSFFDLDPKTDPVRLTQLYEQARWDLLLEEIDCTEEEMMVFAALQYHINKLSQSGEVGEPAGTDPGLDDLDVALSNLEVKLEGSAPTDVLDSLTTIPELKDHLRXFRIPRRPRKLTLKGYRQHWXVXKETTLSYYKSQDEAPGDPIQQLNXKGCEVVPDVNVSGQKFCXKLLXPSPEGMSEIYXRXQDEQQYXRXXXGXRXXSKGRTMADSSYTSEVQAILAFLSLQRTGSGGPGNHPHGPDASAEGLNPYGLVAPRFQRKFKAKQLTPRILEAHQNVAQLSLAEAQLRFIQAWQSLPDFGISYVMVRFKGSRKDEILGIANNRLIRIDLAVGDVVKTWRFSNMRQWNVNWDIRQVAIEFDEHINVAFSCVSASCRIVHEYIGGYIFLSTRERARGEELDEDLFLQLTGGHEAF

SEQ ID NO: 781 - protein, 811 aa, Homo sapiens
  SITE (504)..(504): Xaa at position 504 is Ile, Ala, Val, Leu, or Gly
MLLLFHSKRMPVAEAPQVAGGQGDGGDGEEAEPEGMFKACEDSKRKARGYLRLVPLFVLLALLVLASAGVLLWYFLGYKAEVMVSQVYSGSLRVLNRHFSQDLTRRESSAFRSETAKAQKMLKELITSTRLGTYYNSSSVYSFGEGPLTCFFWFILQIPEHRRLMLSPEVVQALLVEELLSTVNSSAAVPYRAEYEVDPEGLVILEASVKDIAALNSTLGCYRYSYVGQGQVLRLKGPDHLASSCLWHLQGPKDLMLKLRLEWTLAECRDRLAMYDVAGPLEKRLITSVYGCSRQEPVVEVLASGAIMAVVWKKGLHSYYDPFVLSVQPVVFQACEVNLTLDNRLDSQGVLSTPYFPSYYSPQTHCSWHLTVPSLDYGLALWFDAYALRRQKYDLPCTQGQWTIQNRRLCGLRILQPYAERIPVVATAGITINFTSQISLTGPGVRVHYGLYNQSDPCPGEFLCSVNGLCVPACDGVKDCPNGLDERNCVCRATFQCKEDSTCXSLPKVCDGQPDCLNGSDEEQCQEGVPCGTFTFQCEDRSCVKKPNPQCDGRPDCRDGSDEEHCDCGLQGPSSRIVGGAVSSEGEWPWQASLQVRGRHICGGALIADRWVITAAHCFQEDSMASTVLWTVFLGKVWQNSRWPGEVSFKVSRLLLHPYHEEDSHDYDVALLQLDHPVVRSAAVRPVCLPARSHFFEPGLHCWITGWGALREGGPISNALQKVDVQLIPQDLCSEVYRYQVTPRMLCAGYRKGKKDACQGDSGGPLVCKALSGRWFLAGLVSWGLGCGRPNYFGVYTRITGVISWIQQVVT

SEQ ID NO: 782 - protein, 228 aa, Homo sapiens
  SITE (51)..(51): Xaa at position 51 is Leu, Ala, Val, Gly, or Ile
  SITE (53)..(53): Xaa at position 53 is Cys, Ala, Val, Gly, Ser, or Thr
  SITE (64)..(64): Xaa at position 64 is Leu, Ala, Val, Gly, or Ile
  SITE (68)..(68): Xaa at position 68 is Trp, Tyr, Phe, Met, His, Ile, Leu Val, Ala, or Gly
  SITE (79)..(79): Xaa at position 79 is Leu, Ala, Val, Gly, or Ile
  SITE (80)..(80): Xaa at position 80 is Ile, Ala, Val, Leu, or Gly
  SITE (84)..(84): Xaa at position 84 is Val, Ala, Gly, Leu, or Ile
  SITE (101)..(101): Xaa at position 101 is Ile, Ala, Val, Leu, or Gly
  SITE (114)..(114): Xaa at position 114 is Ile, Ala, Val, Leu, or Gly
  SITE (116)..(116): Xaa at position 116 is Ile, Ala, Val, Leu, or Gly
  SITE (118)..(118): Xaa at position 118 is Leu, Ala, Val, Gly, or Ile
  SITE (121)..(121): Xaa at position 121 is Leu, Ala, Val, Gly, or Ile
  SITE (131)..(131): Xaa at position 131 is Cys, Ala, Val, Gly, Ser, or Thr
  SITE (133)..(133): Xaa at position 133 is Val, Ala, Gly, Leu, or Ile
  SITE (149)..(149): Xaa at position 149 is Leu, Ala, Val, Gly, or Ile
MPGAGDGGKAPARWLGTGLLGLFLLPVTLSLEVSVGKATDIYAVNGTEILXPXTFSSCFGFEDXHFRXTYNSSDAFKIXXEGTXKNEKSDPKVTLKDDDRXTLVGSTKEKMNNXSXVXRDXEFSDTGKYTXHXKNPKENNLQHHATIFXQVVDRLEEVDNTVTLIILAVVGGVIGLLILILLIKKLIIFILKKTREKKKECLVSSSGNDNTENGLPGSKAEEKPPSKV

SEQ ID NO: 783 - protein, 196 aa, Homo sapiens
  SITE (27)..(27): Xaa at position 27 is Leu, Ala, Val, Gly, or Ile
  SITE (45)..(45): Xaa at position 45 is Leu, Ala, Val, Gly, or Ile
  SITE (59)..(59): Xaa at position 59 is Ala, Gly, or Pro
  SITE (65)..(65): Xaa at position 65 is Leu, Ala, Val, Gly, or Ile
  SITE (75)..(75): Xaa at position 75 is Leu, Ala, Val, Gly, or Ile
  SITE (82)..(82): Xaa at position 82 is Leu, Ala, Val, Gly, or Ile
  SITE (85)..(85): Xaa at position 85 is Leu, Ala, Val, Gly, or Ile
  SITE (93)..(93): Xaa at position 93 is Ala, Gly, or Pro
  SITE (94)..(94): Xaa at position 94 is Leu, Ala, Val, Gly, or Ile
  SITE (96)..(96): Xaa at position 96 is Ala, Gly, or Pro
  SITE (98)..(98): Xaa at position 98 is Leu, Ala, Val, Gly, or Ile
  SITE (102)..(102): Xaa at position 102 is Leu, Ala, Val, Gly, or Ile
  SITE (126)..(126): Xaa at position 126 is Leu, Ala, Val, Gly, or Ile
  SITE (136)..(136): Xaa at position 136 is Cys, Ala, Val, Gly, Ser, or Thr
  SITE (161)..(161): Xaa at position 161 is Ala, Gly, or Pro
  SITE (169)..(169): Xaa at position 169 is Cys, Ala, Val, Gly, Ser, or Thr
  SITE (174)..(174): Xaa at position 174 is Val, Ala, Gly, Leu, or Ile
  SITE (181)..(181): Xaa at position 181 is Leu, Ala, Val, Gly, or Ile
MTGDCMPVLVLMAAVLTVTGAVPVARXRGALPDARGCHIAQFKSXSPQELQAFKRAKDXLEESLXLKDCKCRSRXFPRTWDXRQXQVRERPVXXEXEXALTXKVLEATADTDPALGDVLDQPLHTXHHILSQLRAXIQPQPTAGPRTRGRLHHWLHRLQEXPKKESPGXLEASXTFNLFRXLTRDLNCVASGDLCV

SEQ ID NO: 784 - protein, 200 aa, Homo sapiens
  SITE (31)..(31): Xaa at position 31 is Leu, Ala, Val, Gly, or Ile
  SITE (49)..(49): Xaa at position 49 is Leu, Ala, Val, Gly, or Ile
  SITE (63)..(63): Xaa at position 63 is Ala, Gly, or Pro
  SITE (69)..(69): Xaa at position 69 is Leu, Ala, Val, Gly, or Ile
  SITE (89)..(89): Xaa at position 89 is Leu, Ala, Val, Gly, or Ile
  SITE (100)..(100): Xaa at position 100 is Ala, Gly, or Pro
  SITE (106)..(106): Xaa at position 106 is Leu, Ala, Val, Gly, or Ile
  SITE (140)..(140): Xaa at position 140 is Cys, Ala, Val, Gly, Ser, or Thr
MKLDMTGDCTPVLVLMAAVLTVTGAVPVARXHGALPDARGCHIAQFKSXSPQELQAFKRAKDXLEESLXLKDCRCHSRLFPRTWDLRQXQVRERPMALEXELALTXKVLEATADTDPALVDVLDQPLHTLHHILSQFRAXIQPQPTAGPRTRGRLHHWLYRLQEAPKKESPGCLEASVTFNLFRLLTRDLNCVASGDLCV

SEQ ID NO: 785 - protein, 508 aa, Homo sapiens
  SITE (451)..(451): Xaa at position 451 is Val, Ala, Gly, Leu, or Ile
  SITE (453)..(453): Xaa at position 453 is Ala, Gly, or Pro
  SITE (465)..(465): Xaa at position 465 is Leu, Ala, Val, Gly, or Ile
  SITE (473)..(473): Xaa at position 473 is Ile, Ala, Val, Leu, or Gly
  SITE (475)..(475): Xaa at position 475 is Val, Ala, Gly, Leu, or Ile
  SITE (476)..(476): Xaa at position 476 is Ile, Ala, Val, Leu, or Gly
  SITE (488)..(488): Xaa at position 488 is Cys, Ala, Val, Gly, Ser, or Thr
  SITE (495)..(495): Xaa at position 495 is Phe, Tyr, Met, His, Ile, Leu, Val Ala, or Gly
MAELQMLLEEEIPSGKRALIESYQNLTRVADYCENNYIQATDKRKALEETKAYTTQSLASVAYQINALANNVLQLLDIQASQLRRMESSINHISQTVDIHKEKVARREIGILTTNKNTSRTHKIIAPANMERPVRYIRKPIDYTVLDDVGHGVKWLKAKHGNNQPARTGTLSRTNPPTQKPPSPPMSGRGTLGRNTPYKTLEPVKPPTVPNDYMTSPARLGSQHSPGRTASLNQRPRTHSGSSGGSGSRENSGSSSIGIPIAVPTPSPPTIGPENISVPPPSGAPPAPPLAPLLPVSTVIAAPGSAPGSQYGTMTRQISRHNSTTSSTSSGGYRRTPSVTAQFSAQPHVNGGPLYSQNSISIAPPPPPMPQLTPQIPLTGFVARVQENIADSPTPPPPPPPDDIPMFDDSPPPPPPPPVDYEDEEAAVVQYNDPYADGDPAWAPKNYIEKXVXIYDYTKDKDDEXSFMEGAIXYXXKKNDDGWYEGVXNRVTGLXPGNYVESIMHYTD

SEQ ID NO: 786 - protein, 778 aa, Homo sapiens
  SITE (438)..(438): Xaa at position 438 is Ile, Ala, Val, Leu, or Gly
  SITE (440)..(440): Xaa at position 440 is Cys, Ala, Val, Gly, Ser, or Thr
  SITE (442)..(442): Xaa at position 442 is Ile, Ala, Val, Leu, or Gly
  SITE (452)..(452): Xaa at position 452 is Ala, Gly, or Pro
  SITE (453)..(453): Xaa at position 453 is Trp, Tyr, Phe, Met, His, Ile, Leu Val, Ala, or Gly
  SITE (483)..(483): Xaa at position 483 is Leu, Ala, Val, Gly, or Ile
  SITE (485)..(485): Xaa at position 485 is Ile, Ala, Val, Leu, or Gly
  SITE (488)..(488): Xaa at position 488 is Ile, Ala, Val, Leu, or Gly
  SITE (497)..(497): Xaa at position 497 is Tyr, Phe, Met, His, Ile, Leu, Val Ala, or Gly
  SITE (499)..(499): Xaa at position 499 is Cys, Ala, Val, Gly, Ser, or Thr
  SITE (501)..(501): Xaa at position 501 is Ala, Gly, or Pro
  SITE (514)..(514): Xaa at position 514 is Leu, Ala, Val, Gly, or Ile
MKPFQLDLLFVCFFLFSQELGLQKRGCCLVLGYMAKDKFRRMNEGQVYSFSQQPQDQVVVSGQPVTLLCAIPEYDGFVLWIKDGLALGVGRDLSSYPQYLVVGNHLSGEHHLKILRAELQDDAVYECQAIQAAIRSRPARLTVLVPPDDPVILGGPVISLRAGDPLNLTCHADNAKPAASIIWLRKGEVINGATYSKTLLRDGKRESIVSTLFISPGDVENGQSIVCRATNKAIPGGKETSVTIDIQHPPLVNLSVEPQPVLEDNVVTFHCSAKANPAVTQYRWAKRGQIIKEASGEVYRTTVDYTYFSEPVSCEVTNALGSTNLSRTVDVYFGPRMTTEPQSLLVDLGSDAIFSCAWTGNPSLTIVWMKRGSGVVLSNEKTLTLKSVRQEDAGKYVCRAVVPRVGAGEREVTLTVNGPPIISSTQTQHALHGEKGQXKXFXRSTPPPDRIXXSWKENVLESGTSGRYTVETISTEEGVISTXTXSNXVRADFQTIXNXTXWNSFGSDTEIIRXKEQGSEMKSGAGLEAESVPMAVIIGVAVGAGVAFLVLMATIVAFCCARSQRNLKGVVSAKNDIRVEIVHKEPASGREGEEHSTIKQLMMDRGEFQQDSVLKQLEVLKEEEKEFQNLKDPTNGYYSVNTFKEHHSTPTISLSSCQPDLRPAGKQRVPTGMSFTNIYSTLSGQGRLYDYGQRFVLGMGSSSIELCEREFQRGSLSDSSSFLDTQCDSSVSSSGKQDGYVQFDKASKASASSSHHSQSSSQNSDPSRPLQRRMQTHV

SEQ ID NO: 787 - protein, 749 aa, Human immunodeficiency virus 1
  SITE (50)..(50): Xaa at position 50 is Cys, Ala, Val, Gly, Ser, or Thr
  SITE (51)..(51): Xaa at position 51 is Ala, Gly, or Pro
  SITE (62)..(62): Xaa at position 62 is His, Phe, Tyr, Lys, Arg, Gly, Ser Thr, Ala, Val, Leu, Ile, Asn, Met, or Gln
  SITE (66)..(66): Xaa at position 66 is Ala, Gly, or Pro
  SITE (91)..(91): Xaa at position 91 is Met, Ile, Leu, Val, Ala, or Gly
  SITE (96)..(96): Xaa at position 96 is Met, Ile, Leu, Val, Ala, or Gly
  SITE (97)..(97): Xaa at position 97 is Val, Ala, Gly, Leu, or Ile
  SITE (100)..(100): Xaa at position 100 is Met, Ile, Leu, Val, Ala, or Gly
  SITE (104)..(104): Xaa at position 104 is Ile, Ala, Val, Leu, or Gly
  SITE (107)..(107): Xaa at position 107 is Leu, Ala, Val, Gly, or Ile
  SITE (116)..(116): Xaa at position 116 is Val, Ala, Gly, Leu, or Ile
  SITE (143)..(143): Xaa at position 143 is Leu, Ala, Val, Gly, or Ile
  SITE (210)..(210): Xaa at position 210 is Ile, Ala, Val, Leu, or Gly
  SITE (212)..(212): Xaa at position 212 is Tyr, Phe, Met, His, Ile, Leu, Val Ala, or Gly
  SITE (213)..(213): Xaa at position 213 is Cys, Ala, Val, Gly, Ser, or Thr
  SITE (219)..(219): Xaa at position 219 is Ala, Gly, or Pro
  SITE (220)..(220): Xaa at position 220 is Ile, Ala, Val, Leu, or Gly
  SITE (223)..(223): Xaa at position 223 is Cys, Ala, Val, Gly, Ser, or Thr
  SITE (234)..(234): Xaa at position 234 is Cys, Ala, Val, Gly, Ser, or Thr
  SITE (237)..(237): Xaa at position 237 is Val, Ala, Gly, Leu, or Ile
  SITE (246)..(246): Xaa at position 246 is Ile, Ala, Val, Leu, or Gly
  SITE (254)..(254): Xaa at position 254 is Leu, Ala, Val, Gly, or Ile
  SITE (265)..(265): Xaa at position 265 is Ile, Ala, Val, Leu, or Gly
  SITE (267)..(267): Xaa at position 267 is Ile, Ala, Val, Leu, or Gly
  SITE (279)..(279): Xaa at position 279 is Ile, Ala, Val, Leu, or Gly
  SITE (280)..(280): Xaa at position 280 is Ile, Ala, Val, Leu, or Gly
  SITE (281)..(281): Xaa at position 281 is Val, Ala, Gly, Leu, or Ile
  SITE (283)..(283): Xaa at position 283 is Leu, Ala, Val, Gly, or Ile
  SITE (287)..(287): Xaa at position 287 is Val, Ala, Gly, Leu, or Ile
  SITE (289)..(289): Xaa at position 289 is Ile, Ala, Val, Leu, or Gly
  SITE (291)..(291): Xaa at position 291 is Cys, Ala, Val, Gly, Ser, or Thr
  SITE (320)..(320): Xaa at position 320 is Ile, Ala, Val, Leu, or Gly
  SITE (323)..(323): Xaa at position 323 is Ala, Gly, or Pro
  SITE (325)..(325): Xaa at position 325 is Cys, Ala, Val, Gly, Ser, or Thr
  SITE (327)..(327): Xaa at position 327 is Val, Ala, Gly, Leu, or Ile
  SITE (332)..(332): Xaa at position 332 is Trp, Tyr, Phe, Met, His, Ile, Leu Val, Ala, or Gly
  SITE (336)..(336): Xaa at position 336 is Leu, Ala, Val, Gly, or Ile
  SITE (339)..(339): Xaa at position 339 is Val, Ala, Gly, Leu, or Ile
  SITE (340)..(340): Xaa at position 340 is Ala, Gly, or Pro
  SITE (343)..(343): Xaa at position 343 is Leu, Ala, Val, Gly, or Ile
  SITE (351)..(351): Xaa at position 351 is Ile, Ala, Val, Leu, or Gly
  SITE (352)..(352): Xaa at position 352 is Ile, Ala, Val, Leu, or Gly
  SITE (366)..(366): Xaa at position 366 is His, Phe, Tyr, Lys, Arg, Gly, Ser Thr, Ala, Val, Leu, Ile, Asn, Met, or Gln
  SITE (375)..(375): Xaa at position 375 is Phe, Tyr, Met, His, Ile, Leu, Val Ala, or Gly
  SITE (377)..(377): Xaa at position 377 is Cys, Ala, Val, Gly, Ser, or Thr
  SITE (383)..(383): Xaa at position 383 is Phe, Tyr, Met, His, Ile, Leu, Val Ala, or Gly
  SITE (408)..(408): Xaa at position 408 is Leu, Ala, Val, Gly, or Ile
  SITE (410)..(410): Xaa at position 410 is Cys, Ala, Val, Gly, Ser, or Thr
  SITE (412)..(412): Xaa at position 412 is Ile, Ala, Val, Leu, or Gly
  SITE (415)..(415): Xaa at position 415 is Ile, Ala, Val, Leu, or Gly
  SITE (416)..(416): Xaa at position 416 is Ile, Ala, Val, Leu, or Gly
  SITE (422)..(422): Xaa at position 422 is Ala, Gly, or Pro
  SITE (425)..(425): Xaa at position 425 is Ala, Gly, or Pro
  SITE (426)..(426): Xaa at position 426 is Met, Ile, Leu, Val, Ala, or Gly
  SITE (441)..(441): Xaa at position 441 is Ile, Ala, Val, Leu, or Gly
  SITE (444)..(444): Xaa at position 444 is Leu, Ala, Val, Gly, or Ile
  SITE (445)..(445): Xaa at position 445 is Leu, Ala, Val, Gly, or Ile
  SITE (446)..(446): Xaa at position 446 is Leu, Ala, Val, Gly, or Ile
  SITE (460)..(460): Xaa at position 460 is Phe, Tyr, Met, His, Ile, Leu, Val Ala, or Gly
  SITE (471)..(471): Xaa at position 471 is Trp, Tyr, Phe, Met, His, Ile, Leu Val, Ala, or Gly
  SITE (475)..(475): Xaa at position 475 is Leu, Ala, Val, Gly, or Ile
  SITE (478)..(478): Xaa at position 478 is Tyr, Phe, Met, His, Ile, Leu, Val Ala, or Gly
  SITE (481)..(481): Xaa at position 481 is Val, Ala, Gly, Leu, or Ile
  SITE (483)..(483): Xaa at position 483 is Ile, Ala, Val, Leu, or Gly
  SITE (497)..(497): Xaa at position 497 is Val, Ala, Gly, Leu, or Ile
  SITE (540)..(540): Xaa at position 540 is Ile, Ala, Val, Leu, or Gly
  SITE (541)..(541): Xaa at position 541 is Val, Ala, Gly, Leu, or Ile
  SITE (547)..(547): Xaa at position 547 is Leu, Ala, Val, Gly, or Ile
  SITE (548)..(548): Xaa at position 548 is Leu, Ala, Val, Gly, or Ile
  SITE (550)..(550): Xaa at position 550 is Ala, Gly, or Pro
  SITE (551)..(551): Xaa at position 551 is Ile, Ala, Val, Leu, or Gly
  SITE (553)..(553): Xaa at position 553 is Ala, Gly, or Pro
  SITE (557)..(557): Xaa at position 557 is Leu, Ala, Val, Gly, or Ile
  SITE (558)..(558): Xaa at position 558 is Leu, Ala, Val, Gly, or Ile
  SITE (562)..(562): Xaa at position 562 is Val, Ala, Gly, Leu, or Ile
  SITE (565)..(565): Xaa at position 565 is Ile, Ala, Val, Leu, or Gly
  SITE (568)..(568): Xaa at position 568 is Leu, Ala, Val, Gly, or Ile
  SITE (572)..(572): Xaa at position 572 is Val, Ala, Gly, Leu, or Ile
  SITE (627)..(627): Xaa at position 627 is Ile, Ala, Val, Leu, or Gly
  SITE (634)..(634): Xaa at position 634 is Ile, Ala, Val, Leu, or Gly
MGIQRNCQHLLTWGIMILGTIIFCSAVENLWVTVYYGVPVWRDADTTLFXXSDAKAYETEKXNVWXTHACVPTDPNPQEIHLGNVTEEFNXWKNNXXEQXHTDXISXWDQSLKPCXKLTPLCVTLHCTNVTTSANITEGKEGXKNCSFNMTTELRDKRQKVYSLFYRLDIVPINENQGNSSNSSEYRLINCNTSAITQACPKVSFEPIPXHXXAPAGFXXLKXKDEGFNGTGLXKNXSTVQCTHGXKPVVSTQXLLNGSLAEKNXTXRSENITNNAKIXXXQXVQPXTXKXIRPNNNTRKSIRIGPGQAFYATGGIIGDXRQXHXNXTRSRXNKTXQQXXEKXRTYFNKTXXFTNSSGGDLEITTXSFNCGGEFXYXNTSGLXNSTWYVNSTWNGTDSTQESNDTITXPXRXKQXXNMWQRXGQXXYAPPIPGVIKCESNXTGXXXTRDGGDNNFANETXRPGGGDMRDNXRSEXYKXKVXEXEPLGVAPTRAKRRXVEREKRAVGIGAVFLGFLGAAGSTMGAASITLTVQARQLLSGXXQQQNNXXRXXEXQQHXXKLTXWGXKQXQARXLAVERYLRDQQLLGIWGCSGKLICTTNVPWNSSWSNKSLDEIWDNMTWLQWDKEXNNYTQTXYRLIEESQNQQEKNEKELLELDKWANLWNWFDISNWLWYIKIFIIIVGGLIGLRIVFAALSVINRVRQGYSPLSFQTHTPNPRGLDRPERIEEEDGEQGRGRSIRLVSGFLALAW

SEQ ID NO: 788 - protein, 852 aa, Human immunodeficiency virus 1
  SITE (54)..(54): Xaa at position 54 is Ala, Gly, or Pro
  SITE (65)..(65): Xaa at position 65 is His, Phe, Tyr, Lys, Arg, Gly, Ser Thr, Ala, Val, Leu, Ile, Asn, Met, or Gln
  SITE (69)..(69): Xaa at position 69 is Ala, Gly, or Pro
  SITE (92)..(92): Xaa at position 92 is Phe, Tyr, Met, His, Ile, Leu, Val Ala, or Gly
  SITE (94)..(94): Xaa at position 94 is Met, Ile, Leu, Val, Ala, or Gly
  SITE (99)..(99): Xaa at position 99 is Met, Ile, Leu, Val, Ala, or Gly
  SITE (100)..(100): Xaa at position 100 is Val, Ala, Gly, Leu, or Ile
  SITE (103)..(103): Xaa at position 103 is Met, Ile, Leu, Val, Ala, or Gly
  SITE (107)..(107): Xaa at position 107 is Ile, Ala, Val, Leu, or Gly
  SITE (110)..(110): Xaa at position 110 is Leu, Ala, Val, Gly, or Ile
  SITE (126)..(126): Xaa at position 126 is Val, Ala, Gly, Leu, or Ile
  SITE (145)..(145): Xaa at position 145 is Ile, Ala, Val, Leu, or Gly
  SITE (152)..(152): Xaa at position 152 is Met, Ile, Leu, Val, Ala, or Gly
  SITE (173)..(173): Xaa at position 173 is Val, Ala, Gly, Leu, or Ile
  SITE (175)..(175): Xaa at position 175 is Ile, Ala, Val, Leu, or Gly
  SITE (189)..(189): Xaa at position 189 is Leu, Ala, Val, Gly, or Ile
  SITE (206)..(206): Xaa at position 206 is Phe, Tyr, Met, His, Ile, Leu, Val Ala, or Gly
  SITE (211)..(211): Xaa at position 211 is Ile, Ala, Val, Leu, or Gly
  SITE (213)..(213): Xaa at position 213 is Tyr, Phe, Met, His, Ile, Leu, Val Ala, or Gly
  SITE (214)..(214): Xaa at position 214 is Cys, Ala, Val, Gly, Ser, or Thr
  SITE (220)..(220): Xaa at position 220 is Ala, Gly, or Pro
  SITE (221)..(221): Xaa at position 221 is Ile, Ala, Val, Leu, or Gly
  SITE (235)..(235): Xaa at position 235 is Cys, Ala, Val, Gly, Ser, or Thr
  SITE (238)..(238): Xaa at position 238 is Val, Ala, Gly, Leu, or Ile
  SITE (247)..(247): Xaa at position 247 is Ile, Ala, Val, Leu, or Gly
  SITE (255)..(255): Xaa at position 255 is Leu, Ala, Val, Gly, or Ile
  SITE (266)..(266): Xaa at position 266 is Val, Ala, Gly, Leu, or Ile
  SITE (280)..(280): Xaa at position 280 is Ile, Ala, Val, Leu, or Gly
  SITE (281)..(281): Xaa at position 281 is Ile, Ala, Val, Leu, or Gly
  SITE (282)..(282): Xaa at position 282 is Val, Ala, Gly, Leu, or Ile
  SITE (284)..(284): Xaa at position 284 is Leu, Ala, Val, Gly, or Ile
  SITE (288)..(288): Xaa at position 288 is Val, Ala, Gly, Leu, or Ile
  SITE (290)..(290): Xaa at position 290 is Ile, Ala, Val, Leu, or Gly
  SITE (321)..(321): Xaa at position 321 is Ile, Ala, Val, Leu, or Gly
  SITE (326)..(326): Xaa at position 326 is Cys, Ala, Val, Gly, Ser, or Thr
  SITE (328)..(328): Xaa at position 328 is Val, Ala, Gly, Leu, or Ile
  SITE (337)..(337): Xaa at position 337 is Leu, Ala, Val, Gly, or Ile
  SITE (340)..(340): Xaa at position 340 is Val, Ala, Gly, Leu, or Ile
  SITE (341)..(341): Xaa at position 341 is Val, Ala, Gly, Leu, or Ile
  SITE (344)..(344): Xaa at position 344 is Leu, Ala, Val, Gly, or Ile
  SITE (352)..(352): Xaa at position 352 is Ile, Ala, Val, Leu, or Gly
  SITE (354)..(354): Xaa at position 354 is Phe, Tyr, Met, His, Ile, Leu, Val Ala, or Gly
  SITE (367)..(367): Xaa at position 367 is His, Phe, Tyr, Lys, Arg, Gly, Ser Thr, Ala, Val, Leu, Ile, Asn, Met, or Gln
  SITE (369)..(369): Xaa at position 369 is Phe, Tyr, Met, His, Ile, Leu, Val Ala, or Gly
  SITE (371)..(371): Xaa at position 371 is Cys, Ala, Val, Gly, Ser, or Thr
  SITE (376)..(376): Xaa at position 376 is Phe, Tyr, Met, His, Ile, Leu, Val Ala, or Gly
  SITE (378)..(378): Xaa at position 378 is Cys, Ala, Val, Gly, Ser, or Thr
  SITE (384)..(384): Xaa at position 384 is Phe, Tyr, Met, His, Ile, Leu, Val Ala, or Gly
  SITE (405)..(405): Xaa at position 405 is Leu, Ala, Val, Gly, or Ile
  SITE (407)..(407): Xaa at position 407 is Cys, Ala, Val, Gly, Ser, or Thr
  SITE (409)..(409): Xaa at position 409 is Ile, Ala, Val, Leu, or Gly
  SITE (412)..(412): Xaa at position 412 is Ile, Ala, Val, Leu, or Gly
  SITE (413)..(413): Xaa at position 413 is Ile, Ala, Val, Leu, or Gly
  SITE (419)..(419): Xaa at position 419 is Val, Ala, Gly, Leu, or Ile
  SITE (422)..(422): Xaa at position 422 is Ala, Gly, or Pro
  SITE (423)..(423): Xaa at position 423 is Met, Ile, Leu, Val, Ala, or Gly
  SITE (438)..(438): Xaa at position 438 is Ile, Ala, Val, Leu, or Gly
  SITE (441)..(441): Xaa at position 441 is Leu, Ala, Val, Gly, or Ile
  SITE (442)..(442): Xaa at position 442 is Ile, Ala, Val, Leu, or Gly
  SITE (443)..(443): Xaa at position 443 is Leu, Ala, Val, Gly, or Ile
  SITE (457)..(457): Xaa at position 457 is Phe, Tyr, Met, His, Ile, Leu, Val Ala, or Gly
  SITE (464)..(464): Xaa at position 464 is Met, Ile, Leu, Val, Ala, or Gly
  SITE (468)..(468): Xaa at position 468 is Trp, Tyr, Phe, Met, His, Ile, Leu Val, Ala, or Gly
  SITE (472)..(472): Xaa at position 472 is Leu, Ala, Val, Gly, or Ile
  SITE (475)..(475): Xaa at position 475 is Tyr, Phe, Met, His, Ile, Leu, Val Ala, or Gly
  SITE (478)..(478): Xaa at position 478 is Val, Ala, Gly, Leu, or Ile
  SITE (480)..(480): Xaa at position 480 is Ile, Ala, Val, Leu, or Gly
  SITE (494)..(494): Xaa at position 494 is Val, Ala, Gly, Leu, or Ile
  SITE (537)..(537): Xaa at position 537 is Ile, Ala, Val, Leu, or Gly
  SITE (538)..(538): Xaa at position 538 is Val, Ala, Gly, Leu, or Ile
  SITE (544)..(544): Xaa at position 544 is Leu, Ala, Val, Gly, or Ile
  SITE (545)..(545): Xaa at position 545 is Leu, Ala, Val, Gly, or Ile
  SITE (547)..(547): Xaa at position 547 is Ala, Gly, or Pro
  SITE (548)..(548): Xaa at position 548 is Ile, Ala, Val, Leu, or Gly
  SITE (550)..(550): Xaa at position 550 is Ala, Gly, or Pro
  SITE (554)..(554): Xaa at position 554 is Leu, Ala, Val, Gly, or Ile
  SITE (555)..(555): Xaa at position 555 is Leu, Ala, Val, Gly, or Ile
  SITE (559)..(559): Xaa at position 559 is Val, Ala, Gly, Leu, or Ile
  SITE (562)..(562): Xaa at position 562 is Ile, Ala, Val, Leu, or Gly
  SITE (565)..(565): Xaa at position 565 is Leu, Ala, Val, Gly, or Ile
  SITE (569)..(569): Xaa at position 569 is Val, Ala, Gly, Leu, or Ile
  SITE (624)..(624): Xaa at position 624 is Ile, Ala, Val, Leu, or Gly
  SITE (631)..(631): Xaa at position 631 is Ile, Ala, Val, Leu, or Gly
MRAMGIQMNCQNLWRWGTMILGMIIFCSAVDNLWVTVYYGVPVWKEAETTLFCXSDAKAYETEKXNVWXTHACVPTDPNPQEIHLENVTEEXNXWKNNXXEQXHTDXISXWDQSLKPCVKLTPLCXTLDCNNVTNNGTSDMREEXKNCSFNXTTELRDKRQKVYSLFYKLDIXQXNEDQGNSSNNKYRXITCNTSAITQACPKVTXEPIPXHXXAPAGFXXLKCKDEEFNGIGPXKNXSTVQCTHGXKPVVSTQXLLNGSLAEKEXKIRCENITNNAKTXXXQXVNPXKXNCTRPNNNTRKSIHIGPGQAFYATGDIIGDXRQAHXNXNRTEWNNTXHQXXEQXRKHFNKTXNXANSTGGDLEITTXSXNXGGEFXYXNTTNLXNSTWNHTASMNSTESNDTIIXPXRXKQXXNMWQRXGQXXYAPPIRGVIRCESNXTGXXXTRDGGNTNSTRETXRPGGGDXRDNXRSEXYKXKVXKXEPLGVAPTKAKRRXVEREKRAVGIGAVFIGFLGAAGSTMGAASITLTVQARQLLSGXXQQQSNXXRXXEXQQHXXKLTXWGXKQXQARXLAVERYLKDQQLLGIWGCSGKLICTTSVPWNSSWSNKSQNEIWDNMTWLQWDKEXSNYTQIXYDLLEESQNQQEKNEQDLLALDKWANLWNWFDISNWLWYIKIFIMIVGGLIGLRIVFAVLSVINRVRQGYSPLSFQTHTPNPRGLDRPERIEEEGGEQDKNRSIRLVSGFLALAWDDLRSLCLFSYHRLRDFILIVARTVELLGHSSLKGLRLGWEGLKYLGNLLSYWGRELRISATNLLDTIAIVIAGWTDRVIEIGQRLCRAFLNIPRRIRQGFERALL

SEQ ID NO: 789 - protein, 816 aa, Homo sapiens
  SITE (55)..(55): Xaa at position 55 is Ile, Ala, Val, Leu, or Gly
  SITE (70)..(70): Xaa at position 70 is Val, Ala, Gly, Leu, or Ile
  SITE (73)..(73): Xaa at position 73 is Tyr, Phe, Met, His, Ile, Leu, Val Ala, or Gly
  SITE (76)..(76): Xaa at position 76 is Val, Ala, Gly, Leu, or Ile
  SITE (78)..(78): Xaa at position 78 is Tyr, Phe, Met, His, Ile, Leu, Val Ala, or Gly
  SITE (88)..(88): Xaa at position 88 is Phe, Tyr, Met, His, Ile, Leu, Val Ala, or Gly
  SITE (109)..(109): Xaa at position 109 is Val, Ala, Gly, Leu, or Ile
  SITE (110)..(110): Xaa at position 110 is Cys, Ala, Val, Gly, Ser, or Thr
  SITE (132)..(132): Xaa at position 132 is Leu, Ala, Val, Gly, or Ile
  SITE (146)..(146): Xaa at position 146 is Cys, Ala, Val, Gly, Ser, or Thr
  SITE (147)..(147): Xaa at position 147 is Leu, Ala, Val, Gly, or Ile
  SITE (149)..(149): Xaa at position 149 is Leu, Ala, Val, Gly, or Ile
  SITE (151)..(151): Xaa at position 151 is Ile, Ala, Val, Leu, or Gly
  SITE (153)..(153): Xaa at position 153 is Val, Ala, Gly, Leu, or Ile
  SITE (168)..(168): Xaa at position 168 is Val, Ala, Gly, Leu, or Ile
  SITE (169)..(169): Xaa at position 169 is Met, Ile, Leu, Val, Ala, or Gly
  SITE (170)..(170): Xaa at position 170 is Val, Ala, Gly, Leu, or Ile
  SITE (172)..(172): Xaa at position 172 is Ile, Ala, Val, Leu, or Gly
  SITE (173)..(173): Xaa at position 173 is His, Phe, Tyr, Lys, Arg, Gly, Ser Thr, Ala, Val, Leu, Ile, Asn, Met, or Gln
  SITE (190)..(190): Xaa at position 190 is Leu, Ala, Val, Gly, or Ile
  SITE (191)..(191): Xaa at position 191 is Ala, Gly, or Pro
  SITE (196)..(196): Xaa at position 196 is Val, Ala, Gly, Leu, or Ile
  SITE (197)..(197): Xaa at position 197 is Ile, Ala, Val, Leu, or Gly
  SITE (198)..(198): Xaa at position 198 is Val, Ala, Gly, Leu, or Ile
  SITE (199)..(199): Xaa at position 199 is Ile, Ala, Val, Leu, or Gly
  SITE (201)..(201): Xaa at position 201 is Ile, Ala, Val, Leu, or Gly
  SITE (203)..(203): Xaa at position 203 is Tyr, Phe, Met, His, Ile, Leu, Val Ala, or Gly
  SITE (207)..(207): Xaa at position 207 is Ile, Ala, Val, Leu, or Gly
  SITE (210)..(210): Xaa at position 210 is Phe, Tyr, Met, His, Ile, Leu, Val Ala, or Gly
  SITE (211)..(211): Xaa at position 211 is Leu, Ala, Val, Gly, or Ile
  SITE (218)..(218): Xaa at position 218 is Ala, Gly, or Pro
  SITE (224)..(224): Xaa at position 224 is Leu, Ala, Val, Gly, or Ile
  SITE (228)..(228): Xaa at position 228 is Ile, Ala, Val, Leu, or Gly
  SITE (230)..(230): Xaa at position 230 is Ala, Gly, or Pro
  SITE (231)..(231): Xaa at position 231 is Leu, Ala, Val, Gly, or Ile
  SITE (233)..(233): Xaa at position 233 is Trp, Tyr, Phe, Met, His, Ile, Leu Val, Ala, or Gly
  SITE (234)..(234): Xaa at position 234 is Ile, Ala, Val, Leu, or Gly
  SITE (238)..(238): Xaa at position 238 is Val, Ala, Gly, Leu, or Ile
  SITE (248)..(248): Xaa at position 248 is Val, Ala, Gly, Leu, or Ile
  SITE (250)..(250): Xaa at position 250 is Ile, Ala, Val, Leu, or Gly
  SITE (251)..(251): Xaa at position 251 is Phe, Tyr, Met, His, Ile, Leu, Val Ala, or Gly
  SITE (257)..(257): Xaa at position 257 is Ala, Gly, or Pro
  SITE (259)..(259): Xaa at position 259 is Cys, Ala, Val, Gly, Ser, or Thr
  SITE (260)..(260): Xaa at position 260 is Val, Ala, Gly, Leu, or Ile
  SITE (262)..(262): Xaa at position 262 is Leu, Ala, Val, Gly, or Ile
  SITE (263)..(263): Xaa at position 263 is Leu, Ala, Val, Gly, or Ile
  SITE (276)..(276): Xaa at position 276 is Ala, Gly, or Pro
  SITE (277)..(277): Xaa at position 277 is Ile, Ala, Val, Leu, or Gly
  SITE (278)..(278): Xaa at position 278 is Ile, Ala, Val, Leu, or Gly
  SITE (288)..(288): Xaa at position 288 is Ala, Gly, or Pro
  SITE (299)..(299): Xaa at position 299 is Ile, Ala, Val, Leu, or Gly
  SITE (300)..(300): Xaa at position 300 is Leu, Ala, Val, Gly, or Ile
  SITE (301)..(301): Xaa at position 301 is Ala, Gly, or Pro
  SITE (304)..(304): Xaa at position 304 is Val, Ala, Gly, Leu, or Ile
  SITE (306)..(306): Xaa at position 306 is Cys, Ala, Val, Gly, Ser, or Thr
  SITE (315)..(315): Xaa at position 315 is Val, Ala, Gly, Leu, or Ile
  SITE (318)..(318): Xaa at position 318 is Leu, Ala, Val, Gly, or Ile
  SITE (326)..(326): Xaa at position 326 is Leu, Ala, Val, Gly, or Ile
  SITE (338)..(338): Xaa at position 338 is Ile, Ala, Val, Leu, or Gly
  SITE (349)..(349): Xaa at position 349 is Ile, Ala, Val, Leu, or Gly
  SITE (365)..(365): Xaa at position 365 is Tyr, Phe, Met, His, Ile, Leu, Val Ala, or Gly
  SITE (367)..(367): Xaa at position 367 is Ile, Ala, Val, Leu, or Gly
  SITE (368)..(368): Xaa at position 368 is Met, Ile, Leu, Val, Ala, or Gly
  SITE (369)..(369): Xaa at position 369 is Leu, Ala, Val, Gly, or Ile
  SITE (380)..(380): Xaa at position 380 is Val, Ala, Gly, Leu, or Ile
  SITE (390)..(390): Xaa at position 390 is Val, Ala, Gly, Leu, or Ile
  SITE (399)..(399): Xaa at position 399 is Val, Ala, Gly, Leu, or Ile
  SITE (402)..(402): Xaa at position 402 is Phe, Tyr, Met, His, Ile, Leu, Val Ala, or Gly
  SITE (403)..(403): Xaa at position 403 is Val, Ala, Gly, Leu, or Ile
  SITE (416)..(416): Xaa at position 416 is Leu, Ala, Val, Gly, or Ile
  SITE (420)..(420): Xaa at position 420 is Ile, Ala, Val, Leu, or Gly
  SITE (440)..(440): Xaa at position 440 is Leu, Ala, Val, Gly, or Ile
  SITE (443)..(443): Xaa at position 443 is Leu, Ala, Val, Gly, or Ile
  SITE (450)..(450): Xaa at position 450 is Val, Ala, Gly, Leu, or Ile
  SITE (457)..(457): Xaa at position 457 is Ala, Gly, or Pro
  SITE (460)..(460): Xaa at position 460 is His, Phe, Tyr, Lys, Arg, Gly, Ser Thr, Ala, Val, Leu, Ile, Asn, Met, or Gln
  SITE (470)..(470): Xaa at position 470 is Tyr, Phe, Met, His, Ile, Leu, Val Ala, or Gly
  SITE (471)..(471): Xaa at position 471 is Ala, Gly, or Pro
  SITE (472)..(472): Xaa at position 472 is Phe, Tyr, Met, His, Ile, Leu, Val Ala, or Gly
  SITE (488)..(488): Xaa at position 488 is Ala, Gly, or Pro
  SITE (493)..(493): Xaa at position 493 is Val, Ala, Gly, Leu, or Ile
  SITE (495)..(495): Xaa at position 495 is Tyr, Phe, Met, His, Ile, Leu, Val Ala, or Gly
  SITE (496)..(496): Xaa at position 496 is Val, Ala, Gly, Leu, or Ile
  SITE (497)..(497): Xaa at position 497 is Phe, Tyr, Met, His, Ile, Leu, Val Ala, or Gly
  SITE (508)..(508): Xaa at position 508 is Phe, Tyr, Met, His, Ile, Leu, Val Ala, or Gly
  SITE (519)..(519): Xaa at position 519 is Leu, Ala, Val, Gly, or Ile
  SITE (523)..(523): Xaa at position 523 is Val, Ala, Gly, Leu, or Ile
  SITE (524)..(524): Xaa at position 524 is Met, Ile, Leu, Val, Ala, or Gly
  SITE (526)..(526): Xaa at position 526 is Tyr, Phe, Met, His, Ile, Leu, Val Ala, or Gly
  SITE (527)..(527): Xaa at position 527 is Trp, Tyr, Phe, Met, His, Ile, Leu Val, Ala, or Gly
  SITE (530)..(530): Xaa at position 530 is Phe, Tyr, Met, His, Ile, Leu, Val Ala, or Gly
  SITE (531)..(531): Xaa at position 531 is Ala, Gly, or Pro
  SITE (558)..(558): Xaa at position 558 is Ala, Gly, or Pro
  SITE (570)..(570): Xaa at position 570 is Leu, Ala, Val, Gly, or Ile
  SITE (572)..(572): Xaa at position 572 is Ile, Ala, Val, Leu, or Gly
  SITE (584)..(584): Xaa at position 584 is Ala, Gly, or Pro
  SITE (589)..(589): Xaa at position 589 is Phe, Tyr, Met, His, Ile, Leu, Val Ala, or Gly
  SITE (603)..(603): Xaa at position 603 is Ile, Ala, Val, Leu, or Gly
MSRPQGLLWLPLLFTPVCVMLNSNVLLWLTALAIKFTLIDSQAQYPVVNTNYGKXRGLRTPLPNEILGPXEQXLGXPXASPPTGERRXQPPEPPSSWTGIRNTTQFAAXXPQHLDERSLLHDMLPIWFTANXDTLMTYVQDQNEDXXYXNXYXPTEDDIHDQNSKKPXXXYXXGGSYMEGTGNMIDGSIXXSYGNXXXXTXNXRLGXLGXXSTGDQAXKGNYGXLDQXQXXRXXEENXGAFGGDPKRXTXXGSGAGXSXXSXXTLSHYSEGLFQKXXXQSGTALSSWXVNYQPAKYTRXXXDKXGXNMLDTTDMXECXRNKNYKEXIQQTITPATYHXAFGPVIDGDVXPDDPQILMEQGEFLNXDXXXGVNQGEGLKFXDGIVDNEDGXTPNDFDFSXSNXXDNLYGYPEGKDTXRETXKFMYTDWADKENPETRRKTXVAXFTDHQWXAPAVATXDLXAQYGSPTYFXXXYHHCQSEMKPSWADSXHGDEXPXXXGIPMIGPTELXSCNFSKNDVMXSAVXXTXXTNXXKTGDPNQPVPQDTKFIHTKPNRFEEVXWSKYNPKDQLYXHXGLKPRVRDHYRXTKVAXWLELVPHLHNLNEXFQYVSTTTKVPPPDMTSFPYGTRRSPAKIWPTTKRPAITPANNPKHSKDPHKTGPEDTTVLIETKRDYSTELSVTIAVGASLLFLNILAFAALYYKKDKRRHETHRRPSPQRNTTNDIAHIQNEEIMSLQMKQLEHDHECESLQAHDTLRLTCPPDYTLTLRRSPDDIPLMTPNTITMIPNTLTGMQPLHTFNTFSGGQNSTNLPHGHSTTRV

SEQ ID NO: 790 - protein, 1196 aa, Homo sapiens
  SITE (1057)..(1057): Xaa at position 1057 is Val, Ala, Gly, Leu, or Ile
  SITE (1058)..(1058): Xaa at position 1058 is Ala, Gly, or Pro
  SITE (1072)..(1072): Xaa at position 1072 is Ile, Ala, Val, Leu, or Gly
  SITE (1078)..(1078): Xaa at position 1078 is Ile, Ala, Val, Leu, or Gly
  SITE (1080)..(1080): Xaa at position 1080 is Val, Ala, Gly, Leu, or Ile
  SITE (1101)..(1101): Xaa at position 1101 is Phe, Tyr, Met, His, Ile, Leu Val, Ala, or Gly
MPTAESEAKVKTKVRFEELLKTHSDLMREKKKLKKKLVRSEENISPDTIRSNLHYMKETTSDDPDTIRSNLPHIKETTSDDVSAANTNNLKKSTRVTKNKLRNTQLATENPNGDASVEEDKQGKPNKKVIKTVPQLTTQDLKPETPENKVDSTHQKTHTKPQPGVDHQKSEKANEGREETDLEEDEELMQAYQCHVTEEMAKEIKRKIRKKLKEQLTYFPSDTLFHDDKLSSEKRKKKKEVPVFSKAETSTLTISGDTVEGEQKKESSVRSVSSDSHQDDEISSMEQSTEDSMQDDTKPKPKKTKKKTKAVADNNEDVDGDGVHEITSRDSPVYPKCLLDDDLVLGVYIHRTDRLKSDFMISHPMVKIHVVDEHTGQYVKKDDSGRPVSSYYEKENVDYILPIMTQPYDFKQLKSRLPEWEEQIVFNENFPYLLRGSDESPKVILFFEILDFLSVDEIKNNSEVQNQECGFRKIAWAFLKLLGANGNANINSKLRLQLYYPPTKPRSPLSVVEAFEWWSKCPRNHYPSTLYVTVRGLKVPDCIKPSYRSMMALQEEKGKPVHCERHHESSSVDTEPGLEESKEVIKWKRLPGQACRIPNKHLFSLNAGERGCFCLDFSHNGRILAAACASRDGYPIILYEIPSGRFMRELCGHLNIIYDLSWSKDDHYILTSSSDGTARIWKNEINNTNTFRVLPHPSFVYTAKFHPAVRELVVTGCYDSMIRIWKVEMREDSAILVRQFDVHKSFINSLCFDTEGHHMYSGDCTGVIVVWNTYVKINDLEHSVHHWTINKEIKETEFKGIPISYLEIHPNGKRLLIHTKDSTLRIMDLRILVARKFVGAANYREKIHSTLTPCGTFLFAGSEDGIVYVWNPETGEQVAMYSDLPFKSPIRDISYHPFENMVAFCAFGQNEPILLYIYDFHVAQQEAEMFKRYNGTFPLPGIHQSQDALCTCPKLPHQGSFQIDEFVHTESSSTKMQLVKQRLETVTEVIRSCAAKVNKNLSFTSPPAVSSQQSKLKQSNMLTAQEILHQFGFTQTGIISIERKPCNHQVDTAPTVXXLYDYTANRSDELTXHRGDIXRXFFKDNEDWWYGSIGKGQEGYXPANHVASETLYQELPPEIKERSPPLSPEEKTKIEKSPAPQKQSINKNKSQDFRLGSESMTHSEMRKEQSHEDQGHIMDTRMRKNKQAGRKVTLIE

SEQ ID NO: 791 - protein, 465 aa, Homo sapiens
  SITE (436)..(436): Xaa at position 436 is Ile, Ala, Val, Leu, or Gly
MGPLKAFLFSPFLLRSQSRGVRLVFLLLTLHLGNCVDKADDEDDEDLTVNKTWVLAPKIHEGDITQILNSLLQGYDNKLRPDIGVRPTVIETDVYVNSIGPVDPINMEYTIDIIFAQTWFDSRLKFNSTMKVLMLNSNMVGKIWIPDTFFRNSRKSDAHWITTPNRLLRIWNDGRVLYTLRLTINAECYLQLHNFPMDEHSCPLEFSSYGYPKNEIEYKWKKPSVEVADPKYWRLYQFAFVGLRNSTEITHTISGDYVIMTIFFDLSRRMGYFTIQTYIPCILTVVLSWVSFWINKDAVPARTSLGITTVLTMTTLSTIARKSLPKVSYVTAMDLFVSVCFIFVFAALMEYGTLHYFTSNQKGKTATKDRKLKNKASMTPGLHPGSTLIPMNNISVPQEDDYGYQCLEGKDCASFFCCFEDCRTGSWREGRIHIRXAKIDSYSRIFFPTAFALFNLVYWVGYLYL

SEQ ID NO: 792 - protein, 712 aa, Homo sapiens
  SITE (13)..(13): Xaa at position 13 is Leu, Ala, Val, Gly, or Ile
  SITE (16)..(16): Xaa at position 16 is Leu, Ala, Val, Gly, or Ile
  SITE (27)..(27): Xaa at position 27 is Val, Ala, Gly, Leu, or Ile
  SITE (28)..(28): Xaa at position 28 is Val, Ala, Gly, Leu, or Ile
  SITE (32)..(32): Xaa at position 32 is Met, Ile, Leu, Val, Ala, or Gly
  SITE (42)..(42): Xaa at position 42 is Cys, Ala, Val, Gly, Ser, or Thr
MAQSSPQLDIQVXHDXRQRFPEIPEGXXSQCXLQNNNNLEAXCRALSQESSKYLYMEYHSPDDNRMNRNRLLHINLGIHSPSSYHPGDGAQLNGGRTLVHSSSDGHIDPQHAAGKQLICLVQEPHSAPAVVAATPNYNPFFMNEQNRSAATPPSQPPQQPSSMQTGMNPSAMQGPSPPPPPPSYMHIPRYSTNPITVTVSQNLPSGQTVPRALQILPQIPSNLYGSPGSIYIRQTSQSSSGRQTPQSTPWQSSPQGPVPHYSQRPLPVYPHQQNYQPSQYSPKQQQIPQSAYHSPPPSQCPSPFSSPQHQVQPSQLGHIFMPPSPSTTPPHPYQQGPPSYQKQGSHSVAYLPYTASSLSKGSMKKIEITVEPSQRPGTAINRSPSPISNQPSPWNQHSLYTATTPPSSSPSRGISSQPKPPFSVNPVYITYTQPTGPSCTPSPSPRVIPNPTTVFKITVGRATTENLLNLVDQEERSAAPEPIQPISVIPGSGGEKGSHKYQRSSSSGSDDYAYTQALLLHQRARMERLAKQLKLEKEELERLKSEVNGMEHDLMQRRLRRVSCTTAIPTPEEMTRLRSMNRQLQINVDCTLKEVDLLQSRGNFDPKAMNNFYDNIEPGPVVPPKPSKKDSSDPCTIERKARRISVTSKVQADIHDTQAAAADEHRTGSTQSPRTQPRDEDYEGAPWNCDSCTFLNHPALNRCEQCEMPRYT

SEQ ID NO: 793 - protein, 796 aa, Homo sapiens
  SITE (69)..(69): Xaa at position 69 is Leu, Ala, Val, Gly, or Ile
  SITE (94)..(94): Xaa at position 94 is Val, Ala, Gly, Leu, or Ile
  SITE (95)..(95): Xaa at position 95 is Val, Ala, Gly, Leu, or Ile
  SITE (117)..(117): Xaa at position 117 is Leu, Ala, Val, Gly, or Ile
  SITE (139)..(139): Xaa at position 139 is Val, Ala, Gly, Leu, or Ile
  SITE (142)..(142): Xaa at position 142 is Ala, Gly, or Pro
  SITE (155)..(155): Xaa at position 155 is Ala, Gly, or Pro
  SITE (158)..(158): Xaa at position 158 is Val, Ala, Gly, Leu, or Ile
  SITE (180)..(180): Xaa at position 180 is Leu, Ala, Val, Gly, or Ile
  SITE (183)..(183): Xaa at position 183 is Ala, Gly, or Pro
  SITE (192)..(192): Xaa at position 192 is Leu, Ala, Val, Gly, or Ile
  SITE (193)..(193): Xaa at position 193 is Ile, Ala, Val, Leu, or Gly
  SITE (194)..(194): Xaa at position 194 is Tyr, Phe, Met, His, Ile, Leu, Val Ala, or Gly
  SITE (195)..(195): Xaa at position 195 is Ile, Ala, Val, Leu, or Gly
  SITE (200)..(200): Xaa at position 200 is Ile, Ala, Val, Leu, or Gly
  SITE (230)..(230): Xaa at position 230 is Leu, Ala, Val, Gly, or Ile
  SITE (231)..(231): Xaa at position 231 is Tyr, Phe, Met, His, Ile, Leu, Val Ala, or Gly
  SITE (235)..(235): Xaa at position 235 is Leu, Ala, Val, Gly, or Ile
  SITE (241)..(241): Xaa at position 241 is Ala, Gly, or Pro
  SITE (251)..(251): Xaa at position 251 is Leu, Ala, Val, Gly, or Ile
  SITE (252)..(252): Xaa at position 252 is Ala, Gly, or Pro
  SITE (254)..(254): Xaa at position 254 is Leu, Ala, Val, Gly, or Ile
  SITE (256)..(256): Xaa at position 256 is Ile, Ala, Val, Leu, or Gly
  SITE (266)..(266): Xaa at position 266 is Ile, Ala, Val, Leu, or Gly
  SITE (280)..(280): Xaa at position 280 is Tyr, Phe, Met, His, Ile, Leu, Val Ala, or Gly
  SITE (294)..(294): Xaa at position 294 is Leu, Ala, Val, Gly, or Ile
  SITE (295)..(295): Xaa at position 295 is Tyr, Phe, Met, His, Ile, Leu, Val Ala, or Gly
  SITE (296)..(296): Xaa at position 296 is Val, Ala, Gly, Leu, or Ile
  SITE (297)..(297): Xaa at position 297 is Val, Ala, Gly, Leu, or Ile
  SITE (299)..(299): Xaa at position 299 is Leu, Ala, Val, Gly, or Ile
  SITE (306)..(306): Xaa at position 306 is Leu, Ala, Val, Gly, or Ile
  SITE (320)..(320): Xaa at position 320 is Tyr, Phe, Met, His, Ile, Leu, Val Ala, or Gly
  SITE (321)..(321): Xaa at position 321 is Ile, Ala, Val, Leu, or Gly
  SITE (324)..(324): Xaa at position 324 is Val, Ala, Gly, Leu, or Ile
  SITE (333)..(333): Xaa at position 333 is Val, Ala, Gly, Leu, or Ile
  SITE (334)..(334): Xaa at position 334 is Val, Ala, Gly, Leu, or Ile
  SITE (336)..(336): Xaa at position 336 is Trp, Tyr, Phe, Met, His, Ile, Leu Val, Ala, or Gly
  SITE (337)..(337): Xaa at position 337 is Leu, Ala, Val, Gly, or Ile
  SITE (345)..(345): Xaa at position 345 is Ile, Ala, Val, Leu, or Gly
  SITE (349)..(349): Xaa at position 349 is Cys, Ala, Val, Gly, Ser, or Thr
  SITE (385)..(385): Xaa at position 385 is Phe, Tyr, Met, His, Ile, Leu, Val Ala, or Gly
  SITE (388)..(388): Xaa at position 388 is Val, Ala, Gly, Leu, or Ile
  SITE (400)..(400): Xaa at position 400 is His, Phe, Tyr, Lys, Arg, Gly, Ser Thr, Ala, Val, Leu, Ile, Asn, Met, or Gln
  SITE (401)..(401): Xaa at position 401 is Val, Ala, Gly, Leu, or Ile
  SITE (402)..(402): Xaa at position 402 is Ala, Gly, or Pro
  SITE (425)..(425): Xaa at position 425 is Val, Ala, Gly, Leu, or Ile
  SITE (438)..(438): Xaa at position 438 is Ile, Ala, Val, Leu, or Gly
  SITE (440)..(440): Xaa at position 440 is Phe, Tyr, Met, His, Ile, Leu, Val Ala, or Gly
  SITE (452)..(452): Xaa at position 452 is Leu, Ala, Val, Gly, or Ile
  SITE (475)..(475): Xaa at position 475 is Cys, Ala, Val, Gly, Ser, or Thr
  SITE (489)..(489): Xaa at position 489 is Phe, Tyr, Met, His, Ile, Leu, Val Ala, or Gly
  SITE (490)..(490): Xaa at position 490 is Leu, Ala, Val, Gly, or Ile
  SITE (493)..(493): Xaa at position 493 is Cys, Ala, Val, Gly, Ser, or Thr
  SITE (503)..(503): Xaa at position 503 is Leu, Ala, Val, Gly, or Ile
  SITE (545)..(545): Xaa at position 545 is Leu, Ala, Val, Gly, or Ile
  SITE (547)..(547): Xaa at position 547 is Leu, Ala, Val, Gly, or Ile
  SITE (549)..(549): Xaa at position 549 is Leu, Ala, Val, Gly, or Ile
  SITE (562)..(562): Xaa at position 562 is Ala, Gly, or Pro
  SITE (563)..(563): Xaa at position 563 is Leu, Ala, Val, Gly, or Ile
  SITE (564)..(564): Xaa at position 564 is Leu, Ala, Val, Gly, or Ile
  SITE (565)..(565): Xaa at position 565 is Leu, Ala, Val, Gly, or Ile
  SITE (576)..(576): Xaa at position 576 is Val, Ala, Gly, Leu, or Ile
  SITE (588)..(588): Xaa at position 588 is Leu, Ala, Val, Gly, or Ile
  SITE (594)..(594): Xaa at position 594 is Val, Ala, Gly, Leu, or Ile
  SITE (595)..(595): Xaa at position 595 is Ile, Ala, Val, Leu, or Gly
  SITE (596)..(596): Xaa at position 596 is Val, Ala, Gly, Leu, or Ile
  SITE (597)..(597): Xaa at position 597 is Ala, Gly, or Pro
  SITE (609)..(609): Xaa at position 609 is Leu, Ala, Val, Gly, or Ile
  SITE (615)..(615): Xaa at position 615 is Ile, Ala, Val, Leu, or Gly
  SITE (622)..(622): Xaa at position 622 is Val, Ala, Gly, Leu, or Ile
  SITE (631)..(631): Xaa at position 631 is Val, Ala, Gly, Leu, or Ile
  SITE (647)..(647): Xaa at position 647 is Ile, Ala, Val, Leu, or Gly
  SITE (655)..(655): Xaa at position 655 is Tyr, Phe, Met, His, Ile, Leu, Val Ala, or Gly
  SITE (657)..(657): Xaa at position 657 is Ala, Gly, or Pro
  SITE (668)..(668): Xaa at position 668 is Phe, Tyr, Met, His, Ile, Leu, Val Ala, or Gly
  SITE (670)..(670): Xaa at position 670 is Cys, Ala, Val, Gly, Ser, or Thr
  SITE (675)..(675): Xaa at position 675 is Ala, Gly, or Pro
  SITE (680)..(680): Xaa at position 680 is Leu, Ala, Val, Gly, or Ile
  SITE (684)..(684): Xaa at position 684 is Ala, Gly, or Pro
  SITE (686)..(686): Xaa at position 686 is Ala, Gly, or Pro
  SITE (687)..(687): Xaa at position 687 is Phe, Tyr, Met, His, Ile, Leu, Val Ala, or Gly
  SITE (692)..(692): Xaa at position 692 is Leu, Ala, Val, Gly, or Ile
  SITE (711)..(711): Xaa at position 711 is Val, Ala, Gly, Leu, or Ile
  SITE (721)..(721): Xaa at position 721 is Ile, Ala, Val, Leu, or Gly
  SITE (723)..(723): Xaa at position 723 is His, Phe, Tyr, Lys, Arg, Gly, Ser Thr, Ala, Val, Leu, Ile, Asn, Met, or Gln
  SITE (730)..(730): Xaa at position 730 is Val, Ala, Gly, Leu, or Ile
  SITE (732)..(732): Xaa at position 732 is Phe, Tyr, Met, His, Ile, Leu, Val Ala, or Gly
  SITE (734)..(734): Xaa at position 734 is His, Phe, Tyr, Lys, Arg, Gly, Ser Thr, Ala, Val, Leu, Ile, Asn, Met, or Gln
  SITE (742)..(742): Xaa at position 742 is Leu, Ala, Val, Gly, or Ile
  SITE (773)..(773): Xaa at position 773 is Ile, Ala, Val, Leu, or Gly
  SITE (777)..(777): Xaa at position 777 is Phe, Tyr, Met, His, Ile, Leu, Val Ala, or Gly
  SITE (781)..(781): Xaa at position 781 is Leu, Ala, Val, Gly, or Ile
MNQTASVSHHIKCQPSKTIKELGSNSPPQRNWKGIAIALLVILVVCSLITMSVILLTPDELTNSSETRXSLEDLFRKDFVLHDPEARWINDTDXXYKSENGHVIKLNIETNATTLLXENTTFVTFKASRHSVSPDLKYXLLXYDVKQIFHYSYTXSYXIYNIHTREVWELNPPEVEDSVXQYXAWGVQGQQXXXXFENNXYYQPDIKSSSLRLTSSGKEEIIFNGIADWXXEEEXLHSHIXHWWSPDGERXXFXMXNDSLVPTMVXPRFTGALYPKGKQXPYPKAGQVNPTIKXXXXNXYGPTHTXELMPPDSFKSREYXXTMXKWVSNTKTXXRXXNRAQNISXLTVXETTTGACSKKYEMTSDTWLSQQNEEPVFSRDGSKFXMTXPVKQGGRGEFHXXXMFLIQSKSEQITVRHLTSGNWEXIKILAYDETTQKXYXLSTESSPRGRQXYSASTEGLLNRQCISCNFMKEQXTYFDASFSPMNQHXXLFXEGPRVPVVSXHSTDNPAKYFILESNSMLKEAILKKKIGKPEIKILHIDDYEXPXQXSLPKDFMDRNQYXXXXIMDEEPGGQLXTDKFHIDWDSVXIDMDNXXXXRFDGRGSGFQGXKILQEXHRRLGSXEVKDQITAXKFLLKLPYIDSKRLSXFGKGYGGXIXSMILKSDEKLXKXGSVVXPITDXKLYXSXXSERYXGMPSKEESTYQAASVLHNXHGLKEENILXIXGTADTKXHXQXSAELIKHXIKAGVNYTMQVYPDEGHNVSEKSKYHLYSTXLKFXSDCXKEEISVLPQEPEEDE

SEQ ID NO: 794 - protein, 692 aa, Homo sapiens
  SITE (80)..(80): Xaa at position 80 is Val, Ala, Gly, Leu, or Ile
  SITE (82)..(82): Xaa at position 82 is Leu, Ala, Val, Gly, or Ile
  SITE (95)..(95): Xaa at position 95 is Ala, Gly, or Pro
  SITE (98)..(98): Xaa at position 98 is Leu, Ala, Val, Gly, or Ile
  SITE (102)..(102): Xaa at position 102 is Ala, Gly, or Pro
  SITE (122)..(122): Xaa at position 122 is Phe, Tyr, Met, His, Ile, Leu, Val Ala, or Gly
  SITE (124)..(124): Xaa at position 124 is Val, Ala, Gly, Leu, or Ile
  SITE (130)..(130): Xaa at position 130 is Leu, Ala, Val, Gly, or Ile
  SITE (134)..(134): Xaa at position 134 is Ala, Gly, or Pro
  SITE (140)..(140): Xaa at position 140 is Val, Ala, Gly, Leu, or Ile
  SITE (143)..(143): Xaa at position 143 is Ile, Ala, Val, Leu, or Gly
  SITE (150)..(150): Xaa at position 150 is Phe, Tyr, Met, His, Ile, Leu, Val Ala, or Gly
  SITE (161)..(161): Xaa at position 161 is Ile, Ala, Val, Leu, or Gly
  SITE (180)..(180): Xaa at position 180 is Val, Ala, Gly, Leu, or Ile
  SITE (182)..(182): Xaa at position 182 is Val, Ala, Gly, Leu, or Ile
  SITE (183)..(183): Xaa at position 183 is Tyr, Phe, Met, His, Ile, Leu, Val Ala, or Gly
  SITE (184)..(184): Xaa at position 184 is Leu, Ala, Val, Gly, or Ile
  SITE (185)..(185): Xaa at position 185 is Leu, Ala, Val, Gly, or Ile
  SITE (193)..(193): Xaa at position 193 is His, Phe, Tyr, Lys, Arg, Gly, Ser Thr, Ala, Val, Leu, Ile, Asn, Met, or Gln
  SITE (196)..(196): Xaa at position 196 is Ile, Ala, Val, Leu, or Gly
  SITE (229)..(229): Xaa at position 229 is His, Phe, Tyr, Lys, Arg, Gly, Ser Thr, Ala, Val, Leu, Ile, Asn, Met, or Gln
  SITE (230)..(230): Xaa at position 230 is Leu, Ala, Val, Gly, or Ile
  SITE (231)..(231): Xaa at position 231 is Ala, Gly, or Pro
  SITE (233)..(233): Xaa at position 233 is Val, Ala, Gly, Leu, or Ile
  SITE (234)..(234): Xaa at position 234 is Val, Ala, Gly, Leu, or Ile
  SITE (242)..(242): Xaa at position 242 is Ala, Gly, or Pro
  SITE (245)..(245): Xaa at position 245 is Ala, Gly, or Pro
  SITE (247)..(247): Xaa at position 247 is Met, Ile, Leu, Val, Ala, or Gly
  SITE (250)..(250): Xaa at position 250 is Leu, Ala, Val, Gly, or Ile
  SITE (252)..(252): Xaa at position 252 is Val, Ala, Gly, Leu, or Ile
  SITE (271)..(271): Xaa at position 271 is Ile, Ala, Val, Leu, or Gly
  SITE (283)..(283): Xaa at position 283 is Leu, Ala, Val, Gly, or Ile
  SITE (284)..(284): Xaa at position 284 is Val, Ala, Gly, Leu, or Ile
  SITE (285)..(285): Xaa at position 285 is Val, Ala, Gly, Leu, or Ile
  SITE (286)..(286): Xaa at position 286 is Leu, Ala, Val, Gly, or Ile
  SITE (287)..(287): Xaa at position 287 is Leu, Ala, Val, Gly, or Ile
  SITE (301)..(301): Xaa at position 301 is Cys, Ala, Val, Gly, Ser, or Thr
  SITE (304)..(304): Xaa at position 304 is Leu, Ala, Val, Gly, or Ile
  SITE (309)..(309): Xaa at position 309 is Val, Ala, Gly, Leu, or Ile
  SITE (310)..(310): Xaa at position 310 is Val, Ala, Gly, Leu, or Ile
  SITE (311)..(311): Xaa at position 311 is Leu, Ala, Val, Gly, or Ile
  SITE (312)..(312): Xaa at position 312 is Val, Ala, Gly, Leu, or Ile
  SITE (314)..(314): Xaa at position 314 is Ala, Gly, or Pro
  SITE (315)..(315): Xaa at position 315 is Ala, Gly, or Pro
  SITE (322)..(322): Xaa at position 322 is Ala, Gly, or Pro
  SITE (328)..(328): Xaa at position 328 is Ala, Gly, or Pro
  SITE (330)..(330): Xaa at position 330 is Ala, Gly, or Pro
  SITE (333)..(333): Xaa at position 333 is Val, Ala, Gly, Leu, or Ile
  SITE (334)..(334): Xaa at position 334 is Ile, Ala, Val, Leu, or Gly
  SITE (336)..(336): Xaa at position 336 is Val, Ala, Gly, Leu, or Ile
  SITE (338)..(338): Xaa at position 338 is Ala, Gly, or Pro
  SITE (346)..(346): Xaa at position 346 is Val, Ala, Gly, Leu, or Ile
  SITE (359)..(359): Xaa at position 359 is Val, Ala, Gly, Leu, or Ile
  SITE (361)..(361): Xaa at position 361 is Leu, Ala, Val, Gly, or Ile
  SITE (362)..(362): Xaa at position 362 is Phe, Tyr, Met, His, Ile, Leu, Val Ala, or Gly
  SITE (363)..(363): Xaa at position 363 is Ala, Gly, or Pro
  SITE (368)..(368): Xaa at position 368 is Ile, Ala, Val, Leu, or Gly
  SITE (371)..(371): Xaa at position 371 is Ala, Gly, or Pro
  SITE (388)..(388): Xaa at position 388 is Ala, Gly, or Pro
  SITE (389)..(389): Xaa at position 389 is Ala, Gly, or Pro
  SITE (390)..(390): Xaa at position 390 is Ala, Gly, or Pro
  SITE (391)..(391): Xaa at position 391 is His, Phe, Tyr, Lys, Arg, Gly, Ser Thr, Ala, Val, Leu, Ile, Asn, Met, or Gln
  SITE (392)..(392): Xaa at position 392 is Val, Ala, Gly, Leu, or Ile
  SITE (393)..(393): Xaa at position 393 is Ala, Gly, or Pro
  SITE (395)..(395): Xaa at position 395 is Ile, Ala, Val, Leu, or Gly
  SITE (396)..(396): Xaa at position 396 is Ala, Gly, or Pro
  SITE (397)..(397): Xaa at position 397 is Ala, Gly, or Pro
  SITE (399)..(399): Xaa at position 399 is Met, Ile, Leu, Val, Ala, or Gly
  SITE (400)..(400): Xaa at position 400 is Leu, Ala, Val, Gly, or Ile
  SITE (409)..(409): Xaa at position 409 is Ala, Gly, or Pro
  SITE (411)..(411): Xaa at position 411 is Leu, Ala, Val, Gly, or Ile
  SITE (415)..(415): Xaa at position 415 is Leu, Ala, Val, Gly, or Ile
  SITE (424)..(424): Xaa at position 424 is Ile, Ala, Val, Leu, or Gly
  SITE (429)..(429): Xaa at position 429 is Phe, Tyr, Met, His, Ile, Leu, Val Ala, or Gly
  SITE (441)..(441): Xaa at position 441 is Val, Ala, Gly, Leu, or Ile
  SITE (442)..(442): Xaa at position 442 is Ala, Gly, or Pro
  SITE (473)..(473): Xaa at position 473 is Ala, Gly, or Pro
  SITE (475)..(475): Xaa at position 475 is Ala, Gly, or Pro
  SITE (484)..(484): Xaa at position 484 is Leu, Ala, Val, Gly, or Ile
  SITE (486)..(486): Xaa at position 486 is Cys, Ala, Val, Gly, Ser, or Thr
  SITE (489)..(489): Xaa at position 489 is Phe, Tyr, Met, His, Ile, Leu, Val Ala, or Gly
  SITE (509)..(509): Xaa at position 509 is Cys, Ala, Val, Gly, Ser, or Thr
  SITE (511)..(511): Xaa at position 511 is Ala, Gly, or Pro
  SITE (520)..(520): Xaa at position 520 is Val, Ala, Gly, Leu, or Ile
  SITE (522)..(522): Xaa at position 522 is Ala, Gly, or Pro
  SITE (523)..(523): Xaa at position 523 is Ile, Ala, Val, Leu, or Gly
  SITE (524)..(524): Xaa at position 524 is Ala, Gly, or Pro
  SITE (526)..(526): Xaa at position 526 is Cys, Ala, Val, Gly, Ser, or Thr
  SITE (527)..(527): Xaa at position 527 is Cys, Ala, Val, Gly, Ser, or Thr
  SITE (542)..(542): Xaa at position 542 is Ala, Gly, or Pro
  SITE (588)..(588): Xaa at position 588 is Cys, Ala, Val, Gly, Ser, or Thr
  SITE (594)..(594): Xaa at position 594 is Ala, Gly, or Pro
  SITE (596)..(596): Xaa at position 596 is Ile, Ala, Val, Leu, or Gly
  SITE (597)..(597): Xaa at position 597 is His, Phe, Tyr, Lys, Arg, Gly, Ser Thr, Ala, Val, Leu, Ile, Asn, Met, or Gln
  SITE (598)..(598): Xaa at position 598 is Ala, Gly, or Pro
  SITE (600)..(600): Xaa at position 600 is Cys, Ala, Val, Gly, Ser, or Thr
  SITE (601)..(601): Xaa at position 601 is Cys, Ala, Val, Gly, Ser, or Thr
  SITE (603)..(603): Xaa at position 603 is Ala, Gly, or Pro
  SITE (606)..(606): Xaa at position 606 is Leu, Ala, Val, Gly, or Ile
  SITE (622)..(622): Xaa at position 622 is Val, Ala, Gly, Leu, or Ile
  SITE (625)..(625): Xaa at position 625 is Ala, Gly, or Pro
  SITE (632)..(632): Xaa at position 632 is Leu, Ala, Val, Gly, or Ile
  SITE (654)..(654): Xaa at position 654 is Cys, Ala, Val, Gly, Ser, or Thr
  SITE (656)..(656): Xaa at position 656 is Val, Ala, Gly, Leu, or Ile
  SITE (672)..(672): Xaa at position 672 is Val, Ala, Gly, Leu, or Ile
  SITE (674)..(674): Xaa at position 674 is Ala, Gly, or Pro
  SITE (676)..(676): Xaa at position 676 is Ala, Gly, or Pro
  SITE (678)..(678): Xaa at position 678 is Cys, Ala, Val, Gly, Ser, or Thr
  SITE (679)..(679): Xaa at position 679 is Cys, Ala, Val, Gly, Ser, or Thr
MGTVSSRRSWWPLPLLLLLLLLLGPAGARAQEDEDGDYEELVLALRSEEDGLAEAPEHGTTATFHRCAKDPWRLPGTYVXVXKEETHLSQSERTXRRXQAQXARRGYLTKILHVFHGLLPGXLXKMSGDXLELXLKLPHXDYXEEDSSVXAQSIPWNLERXTPPRYRADEYQPPDGGSLXEXXXXDTSIQSDXREXEGRVMVTDFENVPEEDGTRFHRQASKCDSHGTXXXGXXSGRDAGVXKGXSXRSXRXLNCQGKGTVSGTLIGLEFXRKSQLVQPVGPXXXXXPLAGGYSRVLNAAXQRXARAGXXXXTXXGNFRDDXCLYSPXSXPEXXTXGXTNAQDQPXTLGTLGTNFGRCXDXXXPGEDXIGXSSDCSTCFVSQSGTSQXXXXXXGXXXMXXSAEPELTLXEXRQRXIHFSAKDVXNEAWXPEDQRVLTPNLXXALPPSTHGAGWQLFCRTVWSAHSGPTRMATXVXRCAPDEELXSXSSXSRSGKRRGERMEAQGGKLVXRXHNAFGGEGXYXXXRXXLLPQANCSVHTAPPXEASMGTRVHCHQQGHVLTGCSSHWEVEDLGTHKPPVLRPRGQPNQXVGHREXSXXXSXXHXPGXECKVKEHGIPAPQEQXTVXCEEGWTXTGCSALPGTSHVLGAYAVDNTXVXRSRDVSTTGSTSEGAXTXVXIXXRSRHLAQASQELQ

SEQ ID NO: 795 - protein, 4307 aa, Homo sapiens
  SITE (1352)..(1352): Xaa at position 1352 is Leu, Ala, Val, Gly, or Ile
  SITE (1356)..(1356): Xaa at position 1356 is Phe, Tyr, Met, His, Ile, Leu Val, Ala, or Gly
  SITE (1368)..(1368): Xaa at position 1368 is Phe, Tyr, Met, His, Ile, Leu Val, Ala, or Gly
  SITE (1411)..(1411): Xaa at position 1411 is Cys, Ala, Val, Gly, Ser, or Thr
  SITE (1419)..(1419): Xaa at position 1419 is Leu, Ala, Val, Gly, or Ile
  SITE (1438)..(1438): Xaa at position 1438 is Leu, Ala, Val, Gly, or Ile
  SITE (1476)..(1476): Xaa at position 1476 is Met, Ile, Leu, Val, Ala, or Gly
  SITE (1484)..(1484): Xaa at position 1484 is Val, Ala, Gly, Leu, or Ile
  SITE (1496)..(1496): Xaa at position 1496 is Val, Ala, Gly, Leu, or Ile
  SITE (1511)..(1511): Xaa at position 1511 is Leu, Ala, Val, Gly, or Ile
  SITE (1515)..(1515): Xaa at position 1515 is Leu, Ala, Val, Gly, or Ile
  SITE (1626)..(1626): Xaa at position 1626 is Trp, Tyr, Phe, Met, His, Ile Leu, Val, Ala, or Gly
  SITE (1640)..(1640): Xaa at position 1640 is Cys, Ala, Val, Gly, Ser, or Thr
  SITE (1644)..(1644): Xaa at position 1644 is Met, Ile, Leu, Val, Ala, or Gly
  SITE (1655)..(1655): Xaa at position 1655 is Tyr, Phe, Met, His, Ile, Leu Val, Ala, or Gly
  SITE (1671)..(1671): Xaa at position 1671 is Cys, Ala, Val, Gly, Ser, or Thr
  SITE (1675)..(1675): Xaa at position 1675 is Leu, Ala, Val, Gly, or Ile
  SITE (1678)..(1678): Xaa at position 1678 is Ala, Gly, or Pro
  SITE (1699)..(1699): Xaa at position 1699 is Val, Ala, Gly, Leu, or Ile
  SITE (1736)..(1736): Xaa at position 1736 is Ala, Gly, or Pro
  SITE (1750)..(1750): Xaa at position 1750 is Val, Ala, Gly, Leu, or Ile
  SITE (1751)..(1751): Xaa at position 1751 is Leu, Ala, Val, Gly, or Ile
  SITE (1753)..(1753): Xaa at position 1753 is Ala, Gly, or Pro
  SITE (1754)..(1754): Xaa at position 1754 is Val, Ala, Gly, Leu, or Ile
  SITE (1764)..(1764): Xaa at position 1764 is Ala, Gly, or Pro
  SITE (1788)..(1788): Xaa at position 1788 is Phe, Tyr, Met, His, Ile, Leu Val, Ala, or Gly
  SITE (1815)..(1815): Xaa at position 1815 is Val, Ala, Gly, Leu, or Ile
  SITE (1826)..(1826): Xaa at position 1826 is Ala, Gly, or Pro
  SITE (1872)..(1872): Xaa at position 1872 is Val, Ala, Gly, Leu, or Ile
  SITE (1901)..(1901): Xaa at position 1901 is Ala, Gly, or Pro
  SITE (1943)..(1943): Xaa at position 1943 is Leu, Ala, Val, Gly, or Ile
  SITE (1962)..(1962): Xaa at position 1962 is Ala, Gly, or Pro
  SITE (1975)..(1975): Xaa at position 1975 is Val, Ala, Gly, Leu, or Ile
  SITE (1976)..(1976): Xaa at position 1976 is Val, Ala, Gly, Leu, or Ile
  SITE (1977)..(1977): Xaa at position 1977 is Ile, Ala, Val, Leu, or Gly
  SITE (1978)..(1978): Xaa at position 1978 is Val, Ala, Gly, Leu, or Ile
  SITE (1989)..(1989): Xaa at position 1989 is Trp, Tyr, Phe, Met, His, Ile Leu, Val, Ala, or Gly
  SITE (1992)..(1992): Xaa at position 1992 is Leu, Ala, Val, Gly, or Ile
  SITE (1995)..(1995): Xaa at position 1995 is Ala, Gly, or Pro
  SITE (2008)..(2008): Xaa at position 2008 is Met, Ile, Leu, Val, Ala, or Gly
  SITE (2053)..(2053): Xaa at position 2053 is Ile, Ala, Val, Leu, or Gly
  SITE (2069)..(2069): Xaa at position 2069 is Val, Ala, Gly, Leu, or Ile
  SITE (2094)..(2094): Xaa at position 2094 is Phe, Tyr, Met, His, Ile, Leu Val, Ala, or Gly
  SITE (2105)..(2105): Xaa at position 2105 is Ala, Gly, or Pro
  SITE (2113)..(2113): Xaa at position 2113 is Ile, Ala, Val, Leu, or Gly
  SITE (2182)..(2182): Xaa at position 2182 is Cys, Ala, Val, Gly, Ser, or Thr
  SITE (2200)..(2200): Xaa at position 2200 is Leu, Ala, Val, Gly, or Ile
  SITE (2208)..(2208): Xaa at position 2208 is Phe, Tyr, Met, His, Ile, Leu Val, Ala, or Gly
  SITE (2254)..(2254): Xaa at position 2254 is Phe, Tyr, Met, His, Ile, Leu Val, Ala, or Gly
  SITE (2275)..(2275): Xaa at position 2275 is Phe, Tyr, Met, His, Ile, Leu Val, Ala, or Gly
  SITE (2278)..(2278): Xaa at position 2278 is Trp, Tyr, Phe, Met, His, Ile Leu, Val, Ala, or Gly
  SITE (2279)..(2279): Xaa at position 2279 is Leu, Ala, Val, Gly, or Ile
  SITE (2301)..(2301): Xaa at position 2301 is Leu, Ala, Val, Gly, or Ile
  SITE (2304)..(2304): Xaa at position 2304 is Ala, Gly, or Pro
  SITE (2354)..(2354): Xaa at position 2354 is Leu, Ala, Val, Gly, or Ile
  SITE (2355)..(2355): Xaa at position 2355 is Val, Ala, Gly, Leu, or Ile
  SITE (2374)..(2374): Xaa at position 2374 is Leu, Ala, Val, Gly, or Ile
  SITE (2376)..(2376): Xaa at position 2376 is Ala, Gly, or Pro
  SITE (2395)..(2395): Xaa at position 2395 is Val, Ala, Gly, Leu, or Ile
  SITE (2403)..(2403): Xaa at position 2403 is Val, Ala, Gly, Leu, or Ile
  SITE (2427)..(2427): Xaa at position 2427 is Leu, Ala, Val, Gly, or Ile
  SITE (2474)..(2474): Xaa at position 2474 is Val, Ala, Gly, Leu, or Ile
  SITE (2476)..(2476): Xaa at position 2476 is Val, Ala, Gly, Leu, or Ile
  SITE (2480)..(2480): Xaa at position 2480 is Val, Ala, Gly, Leu, or Ile
  SITE (2524)..(2524): Xaa at position 2524 is Leu, Ala, Val, Gly, or Ile
  SITE (2526)..(2526): Xaa at position 2526 is Ile, Ala, Val, Leu, or Gly
  SITE (2531)..(2531): Xaa at position 2531 is Ala, Gly, or Pro
  SITE (2548)..(2548): Xaa at position 2548 is Phe, Tyr, Met, His, Ile, Leu Val, Ala, or Gly
  SITE (2572)..(2572): Xaa at position 2572 is Phe, Tyr, Met, His, Ile, Leu Val, Ala, or Gly
  SITE (2634)..(2634): Xaa at position 2634 is Leu, Ala, Val, Gly, or Ile
  SITE (2640)..(2640): Xaa at position 2640 is Ile, Ala, Val, Leu, or Gly
  SITE (2646)..(2646): Xaa at position 2646 is Phe, Tyr, Met, His, Ile, Leu Val, Ala, or Gly
  SITE (2651)..(2651): Xaa at position 2651 is Leu, Ala, Val, Gly, or Ile
  SITE (2653)..(2653): Xaa at position 2653 is Leu, Ala, Val, Gly, or Ile
  SITE (2654)..(2654): Xaa at position 2654 is Ala, Gly, or Pro
  SITE (2668)..(2668): Xaa at position 2668 is Val, Ala, Gly, Leu, or Ile
  SITE (2701)..(2701): Xaa at position 2701 is Ala, Gly, or Pro
  SITE (2708)..(2708): Xaa at position 2708 is Val, Ala, Gly, Leu, or Ile
  SITE (2712)..(2712): Xaa at position 2712 is Leu, Ala, Val, Gly, or Ile
  SITE (2722)..(2722): Xaa at position 2722 is Phe, Tyr, Met, His, Ile, Leu Val, Ala, or Gly
  SITE (2751)..(2751): Xaa at position 2751 is Leu, Ala, Val, Gly, or Ile
  SITE (2777)..(2777): Xaa at position 2777 is His, Phe, Tyr, Lys, Arg, Gly Ser, Thr, Ala, Val, Leu, Ile, Asn, Met, or Gln
  SITE (2780)..(2780): Xaa at position 2780 is Leu, Ala, Val, Gly, or Ile
  SITE (2803)..(2803): Xaa at position 2803 is Cys, Ala, Val, Gly, Ser, or Thr
  SITE (2805)..(2805): Xaa at position 2805 is Val, Ala, Gly, Leu, or Ile
  SITE (2808)..(2808): Xaa at position 2808 is Met, Ile, Leu, Val, Ala, or Gly
  SITE (2819)..(2819): Xaa at position 2819 is Ile, Ala, Val, Leu, or Gly
  SITE (2862)..(2862): Xaa at position 2862 is Cys, Ala, Val, Gly, Ser, or Thr
  SITE (2872)..(2872): Xaa at position 2872 is Tyr, Phe, Met, His, Ile, Leu Val, Ala, or Gly
  SITE (2875)..(2875): Xaa at position 2875 is Phe, Tyr, Met, His, Ile, Leu Val, Ala, or Gly
  SITE (3208)..(3208): Xaa at position 3208 is Ala, Gly, or Pro
  SITE (3209)..(3209): Xaa at position 3209 is Ala, Gly, or Pro
  SITE (3317)..(3317): Xaa at position 3317 is Ala, Gly, or Pro
  SITE (3318)..(3318): Xaa at position 3318 is Val, Ala, Gly, Leu, or Ile
  SITE (3324)..(3324): Xaa at position 3324 is Leu, Ala, Val, Gly, or Ile
  SITE (3332)..(3332): Xaa at position 3332 is Val, Ala, Gly, Leu, or Ile
  SITE (3353)..(3353): Xaa at position 3353 is Val, Ala, Gly, Leu, or Ile
  SITE (3360)..(3360): Xaa at position 3360 is Ile, Ala, Val, Leu, or Gly
  SITE (3383)..(3383): Xaa at position 3383 is Ala, Gly, or Pro
  SITE (3390)..(3390): Xaa at position 3390 is Val, Ala, Gly, Leu, or Ile
  SITE (3403)..(3403): Xaa at position 3403 is Leu, Ala, Val, Gly, or Ile
  SITE (3496)..(3496): Xaa at position 3496 is Ala, Gly, or Pro
  SITE (3509)..(3509): Xaa at position 3509 is Leu, Ala, Val, Gly, or Ile
  SITE (3522)..(3522): Xaa at position 3522 is Ala, Gly, or Pro
  SITE (3571)..(3571): Xaa at position 3571 is Phe, Tyr, Met, His, Ile, Leu Val, Ala, or Gly
  SITE (3572)..(3572): Xaa at position 3572 is Ala, Gly, or Pro
  SITE (3575)..(3575): Xaa at position 3575 is Phe, Tyr, Met, His, Ile, Leu Val, Ala, or Gly
  SITE (3648)..(3648): Xaa at position 3648 is Trp, Tyr, Phe, Met, His, Ile Leu, Val, Ala, or Gly
  SITE (3651)..(3651): Xaa at position 3651 is Tyr, Phe, Met, His, Ile, Leu Val, Ala, or Gly
  SITE (3657)..(3657): Xaa at position 3657 is Cys, Ala, Val, Gly, Ser, or Thr
  SITE (3694)..(3694): Xaa at position 3694 is Ala, Gly, or Pro
  SITE (3724)..(3724): Xaa at position 3724 is Leu, Ala, Val, Gly, or Ile
  SITE (3740)..(3740): Xaa at position 3740 is Leu, Ala, Val, Gly, or Ile
  SITE (3754)..(3754): Xaa at position 3754 is Ala, Gly, or Pro
  SITE (3755)..(3755): Xaa at position 3755 is Met, Ile, Leu, Val, Ala, or Gly
  SITE (3771)..(3771): Xaa at position 3771 is Ala, Gly, or Pro
  SITE (3776)..(3776): Xaa at position 3776 is Trp, Tyr, Phe, Met, His, Ile Leu, Val, Ala, or Gly
  SITE (3777)..(3777): Xaa at position 3777 is Leu, Ala, Val, Gly, or Ile
  SITE (3811)..(3811): Xaa at position 3811 is Ala, Gly, or Pro
  SITE (3822)..(3822): Xaa at position 3822 is Leu, Ala, Val, Gly, or Ile
  SITE (3861)..(3861): Xaa at position 3861 is Ala, Gly, or Pro
  SITE (3868)..(3868): Xaa at position 3868 is Ala, Gly, or Pro
  SITE (3870)..(3870): Xaa at position 3870 is Phe, Tyr, Met, His, Ile, Leu Val, Ala, or Gly
  SITE (3871)..(3871): Xaa at position 3871 is His, Phe, Tyr, Lys, Arg, Gly Ser, Thr, Ala, Val, Leu, Ile, Asn, Met, or Gln
  SITE (3872)..(3872): Xaa at position 3872 is Ala, Gly, or Pro
  SITE (3874)..(3874): Xaa at position 3874 is Cys, Ala, Val, Gly, Ser, or Thr
  SITE (3927)..(3927): Xaa at position 3927 is Tyr, Phe, Met, His, Ile, Leu Val, Ala, or Gly
  SITE (3931)..(3931): Xaa at position 3931 is Ile, Ala, Val, Leu, or Gly
  SITE (3944)..(3944): Xaa at position 3944 is Leu, Ala, Val, Gly, or Ile
  SITE (4021)..(4021): Xaa at position 4021 is Leu, Ala, Val, Gly, or Ile
  SITE (4040)..(4040): Xaa at position 4040 is Leu, Ala, Val, Gly, or Ile
  SITE (4090)..(4090): Xaa at position 4090 is Val, Ala, Gly, Leu, or Ile
  SITE (4140)..(4140): Xaa at position 4140 is Tyr, Phe, Met, His, Ile, Leu Val, Ala, or Gly
  SITE (4141)..(4141): Xaa at position 4141 is Leu, Ala, Val, Gly, or Ile
  SITE (4144)..(4144): Xaa at position 4144 is Leu, Ala, Val, Gly, or Ile
  SITE (4151)..(4151): Xaa at position 4151 is Ile, Ala, Val, Leu, or Gly
  SITE (4202)..(4202): Xaa at position 4202 is Ala, Gly, or Pro
  SITE (4217)..(4217): Xaa at position 4217 is Ile, Ala, Val, Leu, or Gly
  SITE (4225)..(4225): Xaa at position 4225 is Cys, Ala, Val, Gly, Ser, or Thr
  SITE (4248)..(4248): Xaa at position 4248 is Cys, Ala, Val, Gly, Ser, or Thr
  SITE (4301)..(4301): Xaa at position 4301 is Ala, Gly, or Pro
MANGTADVRKLFIFTTTQNYFGLMSELWDQPLLCNCLEINNFLDDGNQMLLRVQRSDAGISFSNTIEFGDTKDKVLVFFKLRPEVITDENLHDNILVSSMLESPISSLYQAVRQVFAPMLLKDQEWSRNFDPKLQNLLSELEAGLGIVLRRSDTNLTKLKFKEDDTRGILTPSDEFQFWIEQAHRGNKQISKERANYFKELFETIAREFYNLDSLSLLEVVDLVETTQDVVDDVWRQTEHDHYPESRMLHLLDIIGGSFGRFVQKKLGTLNLWEDPYYLVKESLKAGISICEQWVIVCNHLTGQVWQRYVPHPWKNEKYFPETLDKLGKRLEEVLAIRTIHEKFLYFLPASEEKIICLTRVFEPFTGLNPVQYNPYTEPLWKAAVSQYEKIIAPAEQKIAGKLKNYISEIQDSPQQLLQAFLKYKELVKRPTISKELMLERETLLARLVDSIKDFRLDFENRCRGIPGDASGPLSGKNLSEVVNSIVWVRQLELKVDDTIKIAEALLSDLPGFRCFHQSAKDLLDQLKLYEQEQFDDWSRDIQSGLSDSRSGLCIEASSRIMELDSNDGLLKVHYSDRLVILLREVRQLSALGFVIPAKIQQVANIAQKFCKQAIILKQVAHFYNSIDQQMIQSQRPMMLQSALAFEQIIKNSKAGSGGKSQITWDNPKELEGYIQKLQNAAERLATENRKLRKWHTTFCEKVVVLMNIDLLRQQQRWKDGLQELRTGLATVEAQGFQASDMHAWKQHWNHQLYKALEHQYQMGLEALNENLPEINIDLTYKQGRLQFRPPFEEIRAKYYREMKRFIGIPNQFKGVGEAGDESIFSIMIDRNASGFLTIFSKAEDLFRRLSAVLHQHKEWIVIGQVDMEALVEKHLFTVHDWEKNFKALKIKGKEVERLPSAVKVDCLNINCNPVKTVIDDLIQKLFDLLVLSLKKSIQAHLHEIDTFVTEAMEVLTIMPQSVEEIGDANLQYSKLQERKPEILPLFQEAEDKNRLLRTVAGGGLETISNLKAKWDKFELMMESHQLMIKDQIEVMKGNVKSRLQIYYQELEKFKARWDQLKPGDDVIETGQHNTLDKSAKLIKEKKIEFDDLEVTRKKLVDDCHHFRLEEPNFSLASSISKDIESCAQIWAFYEEFQQGFQEMANEDWITFRTKTYLFEEFLMNWHDRLRKVEEHSVMTVKLQSEVDKYKIVIPILKYVRGEHLSPDHWLDLFRLLGLPRGTSLEKLLFGDLLRVADTIVAKAADLKDLNSRAQGEVTIREALRELDLWGVGAVFTLIDYEDSQSRTMKLIKDWKDIVNQVGDNRCLLQSLKDSPYYKGFEDKVSIWERKLAELDEYLQNLNHIQRKWVYXEPIXGRGALPKEQTRXNRVDEDFRSIMTDIKKDNRVTTLTTHAGIRNSLLTILDQLQRXQKSLNEFXEEKRSAFPRFYFIGDDDLXEILGQSTNPSVIQSHLKKLFAGINSVCFDEKSKHITAXKSLEGEVXPFKNKVPLSNNXETWLNDLALEMKKTXEQLXKECVTTGRSSQGAVDPSLFPSQILCLAEQIKFTEDVENAIKDHSLHQIETQLVNKLEQYTNIDTSSEDPGNTESGILELKLKALILDIIHNIDVVKQLNQIQVHTTEDWAXKKQLRFYMKSDHTXCVQXVDSEFQYTYEXQGNASKLVYTPLTDKXYLTXTQXMKMGLGGNPYGPAGTGKTESXKALGGLLGRQVLVFNCDEGIDVKSMGRIFVGLVKCGXWGCFDEFNRLEESXXSXXSMQIQTIQDXLKNHRTVCELLGKEVEVNSNSGIXITMNPAGKGYGGRQKLPDNLKQLFRPXAMSHPDNELIXEVILYSEGFKDAKVLSRKLVAIFNLSRELLTPQQHYDWGLRALKTXLRGSGNLLRQLNKSGTTQNANESHIVVQXLRLNTMSKFTFTDCTRFDALIKDVFPGIELKEVEYDELSAAXKQVFEEANYEIIPNQIKKXLELYEQLCQRMGXXXXGPSGAGKSTLXRMXRAXLCKTGKVVKQYTXNPKAMPRYQLLGHIDMDTREWSDGVLTNSARQVVREPQDVSSWIXCDGDIDPEWIESLNSXLDDNRLLTMPSGERIQFGPNVNFVXETHDLSCASPXTISRMGMXFLSDEETDLNSLIKSWLRNQPAEYRNNLENWIGDYFEKALQWVLKQNDYVVETSLVGTVMNGLSHLHGXRDHDEFIINLIRGLGGNXNMKSRLEXTKEVFHWARESPPDFHKPMDTYYDSTRGRLATYVLKKPEDLTADDXSNGLTLPVIQTPDMQRGLDYXKPXXSSDTKQPFILVGPEGCGKGMLXRYXFSQLRSTQIATVHCSAQTTSRHLLQKLSQTCMVISTNTGRVYRPKDCERXXLYLKDINLPKLDKWGTSTXVXFLQQVLTYQGFYDENLEWXGLENIQIXASMSAGGRLGRHKLTTRFTSIVRXCSIDYPEREQLQTIYGAYLEPVLHKNLKNHSIWGSSSKIYLLAGSMXQXYEQXRAKFTVDDYSHYFFTPCILTQWVLGLFRYDLEGGSSNHPLDYVXEXVAYEXRRLFRDKIVGAKELHLXDIILTSVFQGDWGSDILDNMSDSXYVTWGARHNSGARAAPGQPLPPHGKPLGKLNSTDLKDVIKKGLIHYGRDNQNLDILLFHEVXEYMSRXDRVLSXPGGSXLXXGRSGVGRRTITSLXSHMHGAVLFSPKISRGYELKQFKNDLKHVLQLXGIEAQQXVLLXEDYQFVHPTXLEMINSLLSSGEVPGLYTLEELEPLLLPXKDQASQDGFFGPVFNYFTYRIQQNLXIVXIMDSANSNFMINCESNPALHKKXQXLWXEGWSNSSMKKXPEMLFSETGGGEKYNDKKRKEEKKKNSVDPDFLKSFLLIHESXKAYGATPSRXMTXLHVYSAISSSKKKELLKRQSHLQAGVSKLNEAKALVDELNRKAGEQSVLLKTKQDEADAALQMITVSMQDASEQKTELERLKHRIAEEVVKIEERKNKIDDELKEVQPLVNEAKLAVGNIKPESLSEIRSLRMPPDVIRDILEGVLRLMGIFDTSWVSMKSFLAKRGVREDIATFDARNISKEIRESVEELLFKNKGSFDPKNAKRASTAAAPLAAWVKANIQYSHVLERIHPLETEQAGLESNLKKTEDRKRKLEELLNSVGQKVSELKEKFQSRTSEAAKLEAEVSKAQETIKAAEVLINQLDREHKRWNAQVVEITEELATLPKRAQLAXXFITYLSAAPESLRKTCLEEWTKSAGLEKFDLRRFLCTESEQLIWKSEGLPSDDLSIENALVILQSRVCPFLIDPSSQATEWLKTHLKDSRLEVINQQDSNFITALELXXRFGKTXIIQEMDGXEPVLYPLLRRDLVAQGPRYVXQIGDKIXDYNEEFRLFLSTRNPNPFIPPDXASIVTEXNFTTTRSGLRGQXLALTIQHEKPDLEEQKTKLLQQEEDKKIQLAKLEESLLETLATSQGNILENKDLIESLNQTKASSALIQESLKESYKLQISLDQERDAYLPLXESASKMYFIISDXSKINNMYRFSLAXFLRLFQRALQNKQDSENTEQRIQSLISSLQHMVYEYICRCLFKADQLMXXLHXVRGMHPELFQENEWDTFTGVVVGDMLRKADSQQKIRDQLPSWIDQERSWAVATLKIALPSLYQTLCFEDAALXRTXYNNSMXEQEFPSILAKKVSLFQQILVVQALRPDRLQSAMALFXCKTLGLKEVSPLPLNLKRLYKETLEIEPIXIIISPGADPSQELQEXANAERSGECYHQVXXGQGQADLAIQMLKECXRNGDXXCLKNLHLVVSWLPVLEKELNTLQPKDTFRLWLTXEVHPNFTPILXQSSLKITYESPPGLKKNLMRTYESWTPEQISKKDNTHRXHALFSLXWXXXAXQERRNYIPQGWTKFYEFSLSDLRAGYNIIDRLFDGAKDVQWEFVHGLLENAIXGGRXDNYFDLRVLQSYXKQFFNSSVIDVFNQRNKKSIFPYSVSLPQSCSILDYRAVIEKIPEDDKPSFFGLPANIARSSQRMISSQVISQLRIXGRSITAGSKFDREIWSNEXSPVLNLWKKLNQNSNLIHQKVPPPNDRQGSPILSFIILEQFNAIRLVQSXHQSLAALSKVIRGTTLLSSEVQKLASALLNQKCPLAWQSKWEGPEDPLQXXRGXVARALAXQNWVDKAEKQALLSETLDLSELFHPDTFLNALRQETARAVGRSVDSLKFVXSWKGRLQEAKLQIKXSGLLLEGXSFDGNQLSENQLDSPSVSSVLPXFMGWIPQDACGPYSPDECISLPVYTSAERDRVVTNIDVPCGGNQDQWIQCGAXLFLKNQ

SEQ ID NO: 796 - protein, 1073 aa, Homo sapiens
  SITE (150)..(150): Xaa at position 150 is Leu, Ala, Val, Gly, or Ile
  SITE (179)..(179): Xaa at position 179 is Ala, Gly, or Pro
  SITE (199)..(199): Xaa at position 199 is Tyr, Phe, Met, His, Ile, Leu, Val Ala, or Gly
  SITE (211)..(211): Xaa at position 211 is Ile, Ala, Val, Leu, or Gly
  SITE (252)..(252): Xaa at position 252 is Tyr, Phe, Met, His, Ile, Leu, Val Ala, or Gly
  SITE (256)..(256): Xaa at position 256 is Ala, Gly, or Pro
  SITE (269)..(269): Xaa at position 269 is Val, Ala, Gly, Leu, or Ile
  SITE (292)..(292): Xaa at position 292 is Phe, Tyr, Met, His, Ile, Leu, Val Ala, or Gly
  SITE (297)..(297): Xaa at position 297 is Leu, Ala, Val, Gly, or Ile
  SITE (407)..(407): Xaa at position 407 is Ala, Gly, or Pro
  SITE (417)..(417): Xaa at position 417 is Val, Ala, Gly, Leu, or Ile
  SITE (465)..(465): Xaa at position 465 is Leu, Ala, Val, Gly, or Ile
  SITE (521)..(521): Xaa at position 521 is Cys, Ala, Val, Gly, Ser, or Thr
MRVFLLCAYILLLMVSQLRAVSFPEDDEPLNTVDYHYSRQYPVFRGRPSGNESQHRLDFQLMLKIRDTLYIAGRDQVYTVNLNEMPKTEVIPNKKLTWRSRQQDRENCAMKGKHKDECHNFIKVFVPRNDEMVFVCGTNAFNPMCRYYRXSTLEYDGEEISGLARCPFDARQTNVALFXDGKLYSATVADFLASDAVIXRSMGDGSALRTXKYDSKWIKEPHFLHAIEYGNYVYFFFREIAVEHNNLGKAVXSRVXRICKNDMGGSQRXLEKHWTSFLKARLNCSVPGDSFXYFDVXQSITDIIQINGIPTVVGVFTTQLNSIPGSAVCAFSMDDIEKVFKGRFKEQKTPDSVWTAVPEDKVPKPRPGCCAKHGLAEAYKTSIDFPDETLSFIKSHPLMDSAVPPIXDEPWFTKTRXRYRLTAISVDHSAGPYQNYTVIFVGSEAGMVLKVLAKTSPFSLNDSVXLEEIEAYNHAKCSAENEEDKKVISLQLDKDHHALYVAFSSCIIRIPLSRCERYGSXKKSCIASRDPYCGWLSQGSCGRVTPGMLAEGYEQDTEFGNTAHLGDCHEILPTSTTPDYKIFGGPTSDMEVSSSSVTTMASIPEITPKVIDTWRPKLTSSRKFVVQDDPNTSDFTDPLSGIPKGVRWEVQSGESNQMVHMNVLITCVFAAFVLGAFIAGVAVYCYRDMFVRKNRKIHKDAESAQSCTDSSGSFAKLNGLFDSPVKEYQQNIDSPKLYSNLLTSRKELPPNGDTKSMVMDHRGQPPELAALPTPESTPVLHQKTLQAMKSHSEKAHGHGASRKETPQFFPSSPPPHSPLSHGHIPSAIVLPNATHDYNTSFSNSNAHKAEKKLQNIDHPLTKSSSKRDHRRSVDSRNTLNDLLKHLNDPNSNPKAIMGDIQMAHQNLMLDPMGSMSEVPPKVPNREASLYSPPSTLPRNSPTKRVDVPTTPGVPMTSLERQRGYHKNSSQRHSISAMPKNLNSPNGVLLSRQPSMNRGGYMPTPTGAKVDYIQGTPVSVHLQPSLSRQSSYTSNGTLPRTGLKRTPSLKPDVPPKPSFVPQTPSVRPLNKYTY

SEQ ID NO: 797 - protein, 2342 aa, Homo sapiens
  SITE (2149)..(2149): Xaa at position 2149 is Phe, Tyr, Met, His, Ile, Leu Val, Ala, or Gly
  SITE (2151)..(2151): Xaa at position 2151 is Tyr, Phe, Met, His, Ile, Leu Val, Ala, or Gly
  SITE (2154)..(2154): Xaa at position 2154 is Ile, Ala, Val, Leu, or Gly
  SITE (2156)..(2156): Xaa at position 2156 is Leu, Ala, Val, Gly, or Ile
  SITE (2158)..(2158): Xaa at position 2158 is Ile, Ala, Val, Leu, or Gly
  SITE (2197)..(2197): Xaa at position 2197 is Leu, Ala, Val, Gly, or Ile
  SITE (2202)..(2202): Xaa at position 2202 is Ile, Ala, Val, Leu, or Gly
  SITE (2233)..(2233): Xaa at position 2233 is Val, Ala, Gly, Leu, or Ile
  SITE (2236)..(2236): Xaa at position 2236 is Cys, Ala, Val, Gly, Ser, or Thr
  SITE (2239)..(2239): Xaa at position 2239 is Leu, Ala, Val, Gly, or Ile
  SITE (2243)..(2243): Xaa at position 2243 is Ile, Ala, Val, Leu, or Gly
  SITE (2265)..(2265): Xaa at position 2265 is Leu, Ala, Val, Gly, or Ile
  SITE (2267)..(2267): Xaa at position 2267 is Leu, Ala, Val, Gly, or Ile
  SITE (2269)..(2269): Xaa at position 2269 is Phe, Tyr, Met, His, Ile, Leu Val, Ala, or Gly
  SITE (2278)..(2278): Xaa at position 2278 is Phe, Tyr, Met, His, Ile, Leu Val, Ala, or Gly
  SITE (2280)..(2280): Xaa at position 2280 is Ile, Ala, Val, Leu, or Gly
  SITE (2282)..(2282): Xaa at position 2282 is Leu, Ala, Val, Gly, or Ile
  SITE (2309)..(2309): Xaa at position 2309 is Ile, Ala, Val, Leu, or Gly
  SITE (2322)..(2322): Xaa at position 2322 is Tyr, Phe, Met, His, Ile, Leu Val, Ala, or Gly
  SITE (2326)..(2326): Xaa at position 2326 is Val, Ala, Gly, Leu, or Ile
  SITE (2327)..(2327): Xaa at position 2327 is Val, Ala, Gly, Leu, or Ile
  SITE (2330)..(2330): Xaa at position 2330 is Ile, Ala, Val, Leu, or Gly
MDGVSSEANEENDNIERPVRRRHSSILKPPRSPLQDLRGGNERVQESNALRNKKNSRRVSFADTIKVFQTESHMKIVRKSEMEGCSAMVPSQLQLLPPGFKRFSCLSLPETETGENLLLIQNKKLEDNYCEITGMNTLLSAPIHTQMQQKEFSIIEHTRERKHANDQTVIFSDENQMDLTSSHTVMITKGLLDNPISEKSTKIDTTSFLANLKLHTEDSRMKKEVNFSVDQNTSSENKIDFNDFIKRLKTGKCSAFPDVPDKENFEIPIYSKEPNSASSTHQMHVSLKEDENNSNITRLFREKDDGMNFTQCHTANIQTLIPTSSETNSRESKGNDITIYGNDFMDLTFNHTLQILPATGNFSEIENQTQNAMDVTTGYGTKASGNKTVFKSKQNTAFQDLSINSADKIHITRSHIMGAETHIVSQTCNQDARILAMTPESIYSNPSIQGCKTVFYSSCNDAMEMTKCLSNMREEKNLLKHDSNYAKMYCNPDAMSSLTEKTIYSGEENMDITKSHTVAIDNQIFKQDQSNVQIAAAPTPEKEMMLQNLMTTSEDGKMNVNCNSVPHVSKERIQQSLSNPLSISLTDRKTELLSGENMDLTESHTSNLGSQVPLAAYNLAPESTSESHSQSKSSSDECEEITKSRNEPFQRSDIIAKNSLTDTWNKDKDWVLKILPYLDKDSPQSADCNQEIATSHNIVYCGGVLDKQITNRNTVSWEQSLFSTTKPLFSSGQFSMKNHDTAISSHTVKSVLGQNSKLAEPLRKSLSNPTPDYCHDKMIICSEEEQNMDLTKSHTVVIGFGPSELQELGKTNLEHTTGQLTTMNRQIAVKVEKCGKSPIEKSGVLKSNCIMDVLEDESVQKPKFPKEKQNVKIWGRKSVGGPKIDKTIVFSEDDKNDMDITKSYTIEINHRPLLEKRDCHLVPLAGTSETILYTCRQDDMEITRSHTTALECKTVSPDEITTRPMDKTVVFVDNHVELEMTESHTVFIDYQEKERTDRPNFELSQRKSLGTPTVICTPTEESVFFPGNGESDRLVANDSQLTPLEEWSNNRGPVEVADNMELSKSATCKNIKDVQSPGFLNEPLSSKSQRRKSLKLKNDKTIVFSENHKNDMDITQSCMVEIDNESALEDKEDFHLAGASKTILYSCGQDDMEITRSHTTALECKTLLPNEIAIRPMDKTVLFTDNYSDLEVTDSHTVFIDCQATEKILEENPKFGIGKGKNLGVSFPKDNSCVQEIAEKQALAVGNKIVLHTEQKQQLFAATNRTTNEIIKFHSAAMDEKVIGKVVDQACTLEKAQVESCQLNNRDRRNVDFTSSHATAVCGSSDNYSCLPNVISCTDNLEGSAMLLCDKDEEKANYCPVQNDLAYANDFASEYYLESEGQPLSAPCPLLEKEEVIQTSTKGQLDCVITLHKDQDLIKDPRNLLANQTLVYSQDLGEMTKLNSKRVSFKLPKDQMKVYVDDIYVIPQPHFSTDQPPLPKKGQSSINKEEVILSKAGNKSLNIIENSSAPICENKPKILNSEEWFAAACKKELKENIQTTNYNTALDFHSNSDVTKQVIQTHVNAGEAPDPVITSNVPCFHSIKPNLNNLNGKTGEFLAFQTVHLPPLPEQLLELGNKAHNDMHIVQATEIHNINIISSNAKDSRDEENKKSHNGAETTSLPPKTVFKDKVRRCSLGIFLPRLPNKRNCSVTGIDDLEQIPADTTDINHLETQPVSSKDSGIGSVAGKLNLSPSQYINEENLPVYPDEINSSDSINIETEEKALIETYQKEISPYENKMGKTCNSQKRTWVQEEEDIHKEKKIRKNEIKFSDTTQDREIFDHHTEEDIDKSANSVLIKNLSRTPSSCSSSLDSIKADGTSLDFSTYRSSQMESQFLRDTICEESLREKLQDGRITIREFFILLQVHILIQKPRQSNLPGNFTVNTPPTPEDLMLSQYVYRPKIQIYREDCEARRQKIEELKLSASNQDKLLVDINKNLWEKMRHCSDKELKAFGIYLNKIKSCFTKMTKVFTHQGKVALYGKLVQSAQNEREKLQIKIDEMDKILKKIDNCLTEMETETKNLEDEEKNNPVEEWDSEMRAAEKELEQLKTEEEELQRNLLELEVQKEQTLAQIDFMQKQRNRTEELLDQLSLSEWDVVEWSDDQAVFTXVXDTXQXTXTFEESVVGFPFLDKRYRKIVDVNFQSLLDEDQAPPSSLXVHKLXFQYVEEKESWKKTCTTQHQLPKMLEEFSLVXHHXRLXGEEXEYLKRWGPNYNLMNIDINNNEXRXLXSSSAAFAKXEXTXFLSAYYPSVPLPSTIQNHVGNTSQDDXATILSKVPLENNXLKNXXKQXYQDLFQDCHFYH

SEQ ID NO: 798 - protein, 207 aa, Human immunodeficiency virus 1
  SITE (23)..(23): Xaa at position 23 is Met, Ile, Leu, Val, Ala, or Gly
  SITE (24)..(24): Xaa at position 24 is Ile, Ala, Val, Leu, or Gly
  SITE (30)..(30): Xaa at position 30 is Ile, Ala, Val, Leu, or Gly
  SITE (69)..(69): Xaa at position 69 is Leu, Ala, Val, Gly, or Ile
  SITE (100)..(100): Xaa at position 100 is Ala, Gly, or Pro
  SITE (101)..(101): Xaa at position 101 is Ile, Ala, Val, Leu, or Gly
  SITE (115)..(115): Xaa at position 115 is Cys, Ala, Val, Gly, Ser, or Thr
  SITE (118)..(118): Xaa at position 118 is Val, Ala, Gly, Leu, or Ile
  SITE (131)..(131): Xaa at position 131 is Val, Ala, Gly, Leu, or Ile
  SITE (135)..(135): Xaa at position 135 is Leu, Ala, Val, Gly, or Ile
  SITE (136)..(136): Xaa at position 136 is Leu, Ala, Val, Gly, or Ile
  SITE (146)..(146): Xaa at position 146 is Val, Ala, Gly, Leu, or Ile
  SITE (160)..(160): Xaa at position 160 is Ile, Ala, Val, Leu, or Gly
  SITE (161)..(161): Xaa at position 161 is Ile, Ala, Val, Leu, or Gly
  SITE (162)..(162): Xaa at position 162 is Val, Ala, Gly, Leu, or Ile
  SITE (164)..(164): Xaa at position 164 is Leu, Ala, Val, Gly, or Ile
  SITE (168)..(168): Xaa at position 168 is Val, Ala, Gly, Leu, or Ile
  SITE (170)..(170): Xaa at position 170 is Ile, Ala, Val, Leu, or Gly
  SITE (172)..(172): Xaa at position 172 is Cys, Ala, Val, Gly, Ser, or Thr
  SITE (192)..(192): Xaa at position 192 is Ala, Gly, or Pro
  SITE (193)..(193): Xaa at position 193 is Phe, Tyr, Met, His, Ile, Leu, Val Ala, or Gly
  SITE (196)..(196): Xaa at position 196 is Ile, Ala, Val, Leu, or Gly
  SITE (202)..(202): Xaa at position 202 is Met, Ile, Leu, Val, Ala, or Gly
  SITE (206)..(206): Xaa at position 206 is His, Phe, Tyr, Lys, Arg, Gly, Ser Thr, Ala, Val, Leu, Ile, Asn, Met, or Gln
LCVSLKCTDLKNDTNTNSSSGRXXMEKGEXKNCSFNISTSKRGKVQKEYAFFYKLDIIPIDNDTTSYTXTSCNTSVITQACPKVSFEPIPIHYCAPAGFXXLKCNNKTFNGTGPXTNXSTVQCTHGIRPVXSTQXXLNGSLAEEEXVIRSVNFTDNAKTXXXQXNTSXEXNXTRPTNNTRKKIRIQRGPGRXXVTXGKIGNXRQAXC

SEQ ID NO: 799 - protein, 160 aa, Homo sapiens
  SITE (54)..(54): Xaa at position 54 is Ala, Gly, or Pro
  SITE (58)..(58): Xaa at position 58 is Cys, Ala, Val, Gly, Ser, or Thr
  SITE (60)..(60): Xaa at position 60 is Tyr, Phe, Met, His, Ile, Leu, Val Ala, or Gly
  SITE (69)..(69): Xaa at position 69 is Val, Ala, Gly, Leu, or Ile
  SITE (71)..(71): Xaa at position 71 is Val, Ala, Gly, Leu, or Ile
  SITE (73)..(73): Xaa at position 73 is Val, Ala, Gly, Leu, or Ile
  SITE (85)..(85): Xaa at position 85 is Cys, Ala, Val, Gly, Ser, or Thr
  SITE (95)..(95): Xaa at position 95 is Leu, Ala, Val, Gly, or Ile
  SITE (112)..(112): Xaa at position 112 is Val, Ala, Gly, Leu, or Ile
  SITE (116)..(116): Xaa at position 116 is Ile, Ala, Val, Leu, or Gly
  SITE (129)..(129): Xaa at position 129 is Cys, Ala, Val, Gly, Ser, or Thr
  SITE (131)..(131): Xaa at position 131 is Val, Ala, Gly, Leu, or Ile
  SITE (149)..(149): Xaa at position 149 is Ile, Ala, Val, Leu, or Gly
MACLGFQRHKAQLNLATRTWPCTLLFFLLFIPVFCKAMHVAQPAVVLASSRGIXSFVXEXASPGKATEXRXTXLRQADSQVTEVXAATYMMGNEXTFLDDSICTGTSSGNQXNLTXQGLRAMDTGLYIXKXELMYPPPYYLGIGNGTQXYVIDPEPCPDS

SEQ ID NO: 800 - protein, 336 aa, Homo sapiens
  SITE (5)..(5): Xaa at position 5 is Ile, Ala, Val, Leu, or Gly
  SITE (6)..(6): Xaa at position 6 is His, Phe, Tyr, Lys, Arg, Gly, Ser Thr, Ala, Val, Leu, Ile, Asn, Met, or Gln
  SITE (8)..(8): Xaa at position 8 is His, Phe, Tyr, Lys, Arg, Gly, Ser Thr, Ala, Val, Leu, Ile, Asn, Met, or Gln
  SITE (9)..(9): Xaa at position 9 is Ile, Ala, Val, Leu, or Gly
  SITE (10)..(10): Xaa at position 10 is Leu, Ala, Val, Gly, or Ile
  SITE (17)..(17): Xaa at position 17 is Leu, Ala, Val, Gly, or Ile
  SITE (37)..(37): Xaa at position 37 is Ala, Gly, or Pro
  SITE (39)..(39): Xaa at position 39 is Leu, Ala, Val, Gly, or Ile
  SITE (53)..(53): Xaa at position 53 is Cys, Ala, Val, Gly, Ser, or Thr
  SITE (63)..(63): Xaa at position 63 is Met, Ile, Leu, Val, Ala, or Gly
  SITE (72)..(72): Xaa at position 72 is Ala, Gly, or Pro
  SITE (73)..(73): Xaa at position 73 is Leu, Ala, Val, Gly, or Ile
  SITE (79)..(79): Xaa at position 79 is Met, Ile, Leu, Val, Ala, or Gly
  SITE (80)..(80): Xaa at position 80 is Phe, Tyr, Met, His, Ile, Leu, Val Ala, or Gly
  SITE (82)..(82): Xaa at position 82 is Tyr, Phe, Met, His, Ile, Leu, Val Ala, or Gly
  SITE (92)..(92): Xaa at position 92 is Leu, Ala, Val, Gly, or Ile
  SITE (93)..(93): Xaa at position 93 is Cys, Ala, Val, Gly, Ser, or Thr
  SITE (96)..(96): Xaa at position 96 is Leu, Ala, Val, Gly, or Ile
  SITE (100)..(100): Xaa at position 100 is Leu, Ala, Val, Gly, or Ile
  SITE (111)..(111): Xaa at position 111 is Phe, Tyr, Met, His, Ile, Leu, Val Ala, or Gly
  SITE (114)..(114): Xaa at position 114 is Leu, Ala, Val, Gly, or Ile
  SITE (117)..(117): Xaa at position 117 is Leu, Ala, Val, Gly, or Ile
  SITE (119)..(119): Xaa at position 119 is Met, Ile, Leu, Val, Ala, or Gly
  SITE (125)..(125): Xaa at position 125 is Ala, Gly, or Pro
  SITE (129)..(129): Xaa at position 129 is Met, Ile, Leu, Val, Ala, or Gly
  SITE (132)..(132): Xaa at position 132 is Cys, Ala, Val, Gly, Ser, or Thr
  SITE (141)..(141): Xaa at position 141 is Val, Ala, Gly, Leu, or Ile
  SITE (143)..(143): Xaa at position 143 is Ile, Ala, Val, Leu, or Gly
  SITE (147)..(147): Xaa at position 147 is Val, Ala, Gly, Leu, or Ile
  SITE (152)..(152): Xaa at position 152 is Leu, Ala, Val, Gly, or Ile
  SITE (157)..(157): Xaa at position 157 is Leu, Ala, Val, Gly, or Ile
  SITE (160)..(160): Xaa at position 160 is Val, Ala, Gly, Leu, or Ile
  SITE (161)..(161): Xaa at position 161 is Tyr, Phe, Met, His, Ile, Leu, Val Ala, or Gly
  SITE (163)..(163): Xaa at position 163 is Ala, Gly, or Pro
  SITE (164)..(164): Xaa at position 164 is Ala, Gly, or Pro
  SITE (169)..(169): Xaa at position 169 is Cys, Ala, Val, Gly, Ser, or Thr
  SITE (171)..(171): Xaa at position 171 is Leu, Ala, Val, Gly, or Ile
  SITE (172)..(172): Xaa at position 172 is Phe, Tyr, Met, His, Ile, Leu, Val Ala, or Gly
  SITE (173)..(173): Xaa at position 173 is Val, Ala, Gly, Leu, or Ile
  SITE (202)..(202): Xaa at position 202 is Ala, Gly, or Pro
  SITE (203)..(203): Xaa at position 203 is Ile, Ala, Val, Leu, or Gly
  SITE (206)..(206): Xaa at position 206 is Met, Ile, Leu, Val, Ala, or Gly
  SITE (207)..(207): Xaa at position 207 is Ile, Ala, Val, Leu, or Gly
  SITE (211)..(211): Xaa at position 211 is Val, Ala, Gly, Leu, or Ile
  SITE (220)..(220): Xaa at position 220 is Val, Ala, Gly, Leu, or Ile
  SITE (221)..(221): Xaa at position 221 is Cys, Ala, Val, Gly, Ser, or Thr
  SITE (222)..(222): Xaa at position 222 is Phe, Tyr, Met, His, Ile, Leu, Val Ala, or Gly
  SITE (223)..(223): Xaa at position 223 is Ala, Gly, or Pro
  SITE (229)..(229): Xaa at position 229 is Phe, Tyr, Met, His, Ile, Leu, Val Ala, or Gly
  SITE (262)..(262): Xaa at position 262 is Phe, Tyr, Met, His, Ile, Leu, Val Ala, or Gly
  SITE (274)..(274): Xaa at position 274 is Leu, Ala, Val, Gly, or Ile
  SITE (277)..(277): Xaa at position 277 is Leu, Ala, Val, Gly, or Ile
  SITE (286)..(286): Xaa at position 286 is Val, Ala, Gly, Leu, or Ile
  SITE (287)..(287): Xaa at position 287 is Ile, Ala, Val, Leu, or Gly
  SITE (305)..(305): Xaa at position 305 is Ile, Ala, Val, Leu, or Gly
  SITE (308)..(308): Xaa at position 308 is Met, Ile, Leu, Val, Ala, or Gly
  SITE (319)..(319): Xaa at position 319 is Leu, Ala, Val, Gly, or Ile
  SITE (321)..(321): Xaa at position 321 is Ala, Gly, or Pro
  SITE (324)..(324): Xaa at position 324 is Ala, Gly, or Pro
  SITE (327)..(327): Xaa at position 327 is Phe, Tyr, Met, His, Ile, Leu, Val Ala, or Gly
MKIDXXSXXXPKEWPDXKKRFGYGGWVQLQHHSKGEXKXLKDGKVFRVVRENXWDPEVRIREXDQKGVTVQXXSTVPVXXSXWAKPEDTLNXXQLXNNDXASTVVSYPRRXVGXGTXPXQAPELXVKEXERXVKELGFPGXQXGTHXNEWDXNAQEXFPXXAXXERLKXSXXXHPWDMQMDGRMAKYWLPWLVGMPAETTIXXCSXXMGGXFEKFPKLKXXXXHGGGAXPFTVGRISHGFSMRPDLCAQDNPMNPKKYLGSXYTDALVHDPLSXKLXTDVIGKDKXXLGTDYPFPLGELEPGKLXESXEEFDEETKNKXKXGNXLAXLGLERKQFE

SEQ ID NO: 801 - protein, 1205 aa, Homo sapiens
  SITE (12)..(12): Xaa at position 12 is Ile, Ala, Val, Leu, or Gly
  SITE (434)..(434): Xaa at position 434 is Leu, Ala, Val, Gly, or Ile
  SITE (499)..(499): Xaa at position 499 is Ile, Ala, Val, Leu, or Gly
  SITE (509)..(509): Xaa at position 509 is Leu, Ala, Val, Gly, or Ile
  SITE (527)..(527): Xaa at position 527 is Ile, Ala, Val, Leu, or Gly
  SITE (533)..(533): Xaa at position 533 is Ile, Ala, Val, Leu, or Gly
  SITE (550)..(550): Xaa at position 550 is Leu, Ala, Val, Gly, or Ile
  SITE (553)..(553): Xaa at position 553 is Val, Ala, Gly, Leu, or Ile
  SITE (558)..(558): Xaa at position 558 is Leu, Ala, Val, Gly, or Ile
  SITE (566)..(566): Xaa at position 566 is Ala, Gly, or Pro
  SITE (584)..(584): Xaa at position 584 is Ile, Ala, Val, Leu, or Gly
MKVTVCFGRTGXVVPCKEGQLRVGELTQQALQRYLKTREKGPGYWVKIHHLEYTDGGILDPDDVLADVVEDKDKLIAVFEEQEPLHKIESPSGNPADRQSPDAFETEVAAQLAAFKPIGGEIEVTPSALKLGTPLLVRRSSDPVPGPPADTQPSASHPGGQSLKLVVPDSTQNLEDREVLNGVQTELLTSPRTKDTLSDMTRTVEISGEGGPLGIHVVPFFSSLSGRILGLFIRGIEDNSRSKREGLFHENECIVKINNVDLVDKTFAQAQDVFRQAMKSPSVLLHVLPPQNREQYEKSVIGSLNIFGNNDGVLKTKVPPPVHGKSGLKTANLTGTDSPETDASASLQQNKSPRVPRLGGKPSSPSLSPLMGFGSNKNAKKIKIDLKKGPEGLGFTVVTRDSSIHGPGPIFVKNILPKGAAIKDGRLQSGDRIXEVNGRDVTGRTQEELVAMLRSTKQGETASLVIARQEGHFLPRELKGEPDCCALSLETSEQLTFEXPLNDSGSAGXGVSLKGNKSRETGTDLGXFIKSIXHGGAAFKDGRLRMNDQXIAXNGESXLGKSNHEXMETLRRSMSMEGNIRGMXQLVILRRPERPMEDPAECGAFSKPCFENCQNAVTTSRRNDNSILHPLGTCSPQDKQKGLLLPNDGWAESEVPPSPTPHSALGLGLEDYSHSSGVDSAVYFPDQHINFRSVTPARQPESINLKASKSMDLVPDESKVHSLAGQKSESPSKDFGPTLGLKKSSSLESLQTAVAEVRKNDLPFHRPRPHMVRGRGCNESFRAAIDKSYDGPEEIEADGLSDKSSHSGQGALNCESAPQGNSELEDMENKARKVKKTKEKEKKKEKGKLKVKEKKRKEENEDPERKIKKKGFGAMLRFGKKKEDKGGKAEQKGTLKHGGLREEELEKMKEERERIGAKHQELREKQARGLLDYATGAIGSVYDMDDDEMDPNYARVNHFREPCTSANVFRSPSPPRAGPFGYPRDGHPLSPERDHLEGLYAKVNKPYHPLVPADSGRPTGGSTDRIQKLRKEYYQARREGFPLYEDDEGRARPSEYDLLWVPGRGPDGNAHNLRFEGMERQYASLPRGGPADPVDYLPAAPRGLYKERELPYYPGAHPMHPPKGSYPRPTELRVADLRYPQHYPPPPAPQHKGPFRQDVPPSPPQHQRMPAYQETGRPGPRGGSPDQYPYRTQDSRQKNPMTAAV

SEQ ID NO: 802 - protein, 1996 aa, Homo sapiens
  SITE (30)..(30): Xaa at position 30 is Ala, Gly, or Pro
  SITE (32)..(32): Xaa at position 32 is Leu, Ala, Val, Gly, or Ile
  SITE (63)..(63): Xaa at position 63 is Ala, Gly, or Pro
  SITE (70)..(70): Xaa at position 70 is Leu, Ala, Val, Gly, or Ile
  SITE (76)..(76): Xaa at position 76 is Val, Ala, Gly, Leu, or Ile
  SITE (79)..(79): Xaa at position 79 is Ile, Ala, Val, Leu, or Gly
  SITE (91)..(91): Xaa at position 91 is Ala, Gly, or Pro
  SITE (102)..(102): Xaa at position 102 is Leu, Ala, Val, Gly, or Ile
  SITE (104)..(104): Xaa at position 104 is Leu, Ala, Val, Gly, or Ile
  SITE (106)..(106): Xaa at position 106 is Val, Ala, Gly, Leu, or Ile
MMRTTEDFHKPSATLNSNTATKGRYIYLEXFXEGGAPWGFTLKGGLEHGEPLIISKVEEGGKXDTLSSKXQAGDEXVHXNEVTLSSSRKEXVSLVKGSYKTXRXVXRRDVCTDPGHADTGASNFVSPEHLTSGPQHRKAAWSGGVKLRLKHRRSEPAGRPHSWHTTKSGEKQPDASMMQISQGMIGPPWHQSYHSSSSTSDLSNYDHAYLRRSPDQCSSQGSMESLEPSGAYPPCHLSPAKSTGSIDQLSHFHNKRDSAYSSFSTSSSILEYPHPGISGRERSGSMDNTSARGGLLEGMRQADIRYVKTVYDTRRGVSAEYEVNSSALLLQGREARASANGQGYDKWSNIPRGKGVPPPSWSQQCPSSLETATDNLPPKVGAPLPPARSDSYAAFRHRERPSSWSSLDQKRLCRPQANSLGSLKSPFIEEQLHTVLEKSPENSPPVKPKHNYTQKAQPGQPLLPTSIYPVPSLEPHFAQVPQPSVSSNGMLYPALAKESGYIAPQGACNKMATIDENGNQNGSGRPGFAFCQPLEHDLLSPVEKKPEATAKYVPSKVHFCSVPENEEDASLKRHLTPPQGNSPHSNERKSTHSNKPSSHPHSLKCPQAQAWQAGEDKRSSRLSEPWEGDFQEDHNANLWRRLEREGLGQSLSGNFGKTKSAFSSLQNIPESLRRHSSLELGRGTQEGYPGGRPTCAVNTKAEDPGRKAAPDLGSHLDRQVSYPRPEGRTGASASFNSTDPSPEEPPAPSHPHTSSLGRRGPGPGSASALQGFQYGKPHCSVLEKVSKFEQREQGSQRPSVGGSGFGHNYRPHRTVSTSSTSGNDFEETKAHIRFSESAEPLGNGEQHFKNGELKLEEASRQPCGQQLSGGASDSGRGPQRPDARLLRSQSTFQLSSEPEREPEWRDRPGSPESPLLDAPFSRAYRNSIKDAQSRVLGATSFRRRDLELGAPVASRSWRPRPSSAHVGLRSPEASASASPHTPRERHSVTPAEGDLARPVPPAARRGARRRLTPEQKKRSYSEPEKMNEVGIVEEAEPAPLGPQRNGMRFPESSVADRRRLFERDGKACSTLSLSGPELKQFQQSALADYIQRKTGKRPTSAAGCSLQEPGPLRERAQSAYLQPGPAALEGSGLASASSLSSLREPSLQPRREATLLPATVAETQQAPRDRSSSFAGGRRLGERRRGDLLSGANGGTRGTQRGDETPREPSSWGARAGKSMSAEDLLERSDVLAGPVHVRSRSSPATADKRQDVLLGQDSGFGLVKDPCYLAGPGSRSLSCSERGQEEMLPLFHHLTPRWGGSGCKAIGDSSVPSECPGTLDHQRQASRTPCPRPPLAGTQGLVTDTRAAPLTPIGTPLPSAIPSGYCSQDGQTGRQPLPPYTPAMMHRSNGHTLTQPPGPRGCEGDGPEHGVEEGTRKRVSLPQWPPPSRAKWAHAAREDSLPEESSAPDFANLKHYQKQQSLPSLCSTSDPDTPLGAPSTPGRISLRISESVLRDSPPPHEDYEDEVFVRDPHPKATSSPTFEPLPPPPPPPPSQETPVYSMDDFPPPPPHTVCEAQLDSEDPEGPRPSFNKLSKVTIARERHMPGAAHVVGSQTLASRLQTSIKGSEAESTPPSFMSVHAQLAGSLGGQPAPIQTQSLSHDPVSGTQGLEKKVSPDPQKSSEDIRTEALAKEIVHQDKSLADILDPDSRLKTTMDLMEGLFPRDVNLLKENSVKRKAIQRTVSSSGCEGKRNEDKEAVSMLVNCPAYYSVSAPKAELLNKIKEMPAEVNEEEEQADVNEKKAELIGSLTHKLETLQEAKGSLLTDIKLNNALGEEVEALISELCKPNEFDKYRMFIGDLDKVVNLLLSLSGRLARVENVLSGLGEDASNEERSSLYEKRKILAGQHEDARELKENLDRRERVVLGILANYLSEEQLQDYQHFVKMKSTLLIEQRKLDDKIKLGQEQVKCLLESLPSDFIPKAGALALPPNLTSEPIPAGGCTFSGIFPTLTSPL

SEQ ID NO: 803 - protein, 313 aa, Homo sapiens
  SITE (41)..(41): Xaa at position 41 is Cys, Ala, Val, Gly, Ser, or Thr
  SITE (48)..(48): Xaa at position 48 is Cys, Ala, Val, Gly, Ser, or Thr
  SITE (58)..(58): Xaa at position 58 is Leu, Ala, Val, Gly, or Ile
  SITE (70)..(70): Xaa at position 70 is Cys, Ala, Val, Gly, Ser, or Thr
  SITE (81)..(81): Xaa at position 81 is Leu, Ala, Val, Gly, or Ile
  SITE (82)..(82): Xaa at position 82 is Val, Ala, Gly, Leu, or Ile
  SITE (83)..(83): Xaa at position 83 is Ala, Gly, or Pro
  SITE (85)..(85): Xaa at position 85 is Val, Ala, Gly, Leu, or Ile
  SITE (94)..(94): Xaa at position 94 is Cys, Ala, Val, Gly, Ser, or Thr
  SITE (100)..(100): Xaa at position 100 is Trp, Tyr, Phe, Met, His, Ile, Leu Val, Ala, or Gly
  SITE (129)..(129): Xaa at position 129 is Ala, Gly, or Pro
  SITE (139)..(139): Xaa at position 139 is Tyr, Phe, Met, His, Ile, Leu, Val Ala, or Gly
  SITE (147)..(147): Xaa at position 147 is Leu, Ala, Val, Gly, or Ile
  SITE (149)..(149): Xaa at position 149 is Ile, Ala, Val, Leu, or Gly
  SITE (151)..(151): Xaa at position 151 is His, Phe, Tyr, Lys, Arg, Gly, Ser Thr, Ala, Val, Leu, Ile, Asn, Met, or Gln
  SITE (152)..(152): Xaa at position 152 is Val, Ala, Gly, Leu, or Ile
  SITE (161)..(161): Xaa at position 161 is Trp, Tyr, Phe, Met, His, Ile, Leu Val, Ala, or Gly
  SITE (167)..(167): Xaa at position 167 is Leu, Ala, Val, Gly, or Ile
  SITE (176)..(176): Xaa at position 176 is Leu, Ala, Val, Gly, or Ile
  SITE (183)..(183): Xaa at position 183 is Leu, Ala, Val, Gly, or Ile
  SITE (186)..(186): Xaa at position 186 is Ile, Ala, Val, Leu, or Gly
  SITE (187)..(187): Xaa at position 187 is Tyr, Phe, Met, His, Ile, Leu, Val Ala, or Gly
  SITE (200)..(200): Xaa at position 200 is Trp, Tyr, Phe, Met, His, Ile, Leu Val, Ala, or Gly
  SITE (236)..(236): Xaa at position 236 is Val, Ala, Gly, Leu, or Ile
  SITE (238)..(238): Xaa at position 238 is Phe, Tyr, Met, His, Ile, Leu, Val Ala, or Gly
  SITE (240)..(240): Xaa at position 240 is Val, Ala, Gly, Leu, or Ile
  SITE (241)..(241): Xaa at position 241 is Phe, Tyr, Met, His, Ile, Leu, Val Ala, or Gly
  SITE (246)..(246): Xaa at position 246 is Ala, Gly, or Pro
  SITE (247)..(247): Xaa at position 247 is Ala, Gly, or Pro
  SITE (249)..(249): Xaa at position 249 is Ala, Gly, or Pro
  SITE (250)..(250): Xaa at position 250 is Leu, Ala, Val, Gly, or Ile
  SITE (251)..(251): Xaa at position 251 is Cys, Ala, Val, Gly, Ser, or Thr
  SITE (254)..(254): Xaa at position 254 is Met, Ile, Leu, Val, Ala, or Gly
  SITE (264)..(264): Xaa at position 264 is His, Phe, Tyr, Lys, Arg, Gly, Ser Thr, Ala, Val, Leu, Ile, Asn, Met, or Gln
  SITE (265)..(265): Xaa at position 265 is Cys, Ala, Val, Gly, Ser, or Thr
  SITE (272)..(272): Xaa at position 272 is Phe, Tyr, Met, His, Ile, Leu, Val Ala, or Gly
  SITE (280)..(280): Xaa at position 280 is Cys, Ala, Val, Gly, Ser, or Thr
  SITE (283)..(283): Xaa at position 283 is Phe, Tyr, Met, His, Ile, Leu, Val Ala, or Gly
  SITE (286)..(286): Xaa at position 286 is Phe, Tyr, Met, His, Ile, Leu, Val Ala, or Gly
  SITE (303)..(303): Xaa at position 303 is Ile, Ala, Val, Leu, or Gly
  SITE (306)..(306): Xaa at position 306 is Ala, Gly, or Pro
  SITE (307)..(307): Xaa at position 307 is Ala, Gly, or Pro
  SITE (309)..(309): Xaa at position 309 is Leu, Ala, Val, Gly, or Ile
  SITE (310)..(310): Xaa at position 310 is Leu, Ala, Val, Gly, or Ile
  SITE (311)..(311): Xaa at position 311 is Phe, Tyr, Met, His, Ile, Leu, Val Ala, or Gly
  SITE (312)..(312): Xaa at position 312 is Tyr, Phe, Met, His, Ile, Leu, Val Ala, or Gly
MNQLSFLLFLIATTRGWSTDEANTYFKEWTCSSSPSLPRSXKEIKDEXPSAFDGLYFXRTENGVIYQTFXDMTSGGGGWTXXXSXHENDMRGKXTVGDRXSSQQGSKAVYPEGDGNWANYNTFGSAEAXTSDDYKNPGXYDIQAKDXGXWXXPNKSPMQHXRNSSLXRYRTDTGFXQTLGHNXFGXXQKYPVKYGEGKCXTDNGPVIPVVYDFGDAQKTASYYSPYGQREFTAGFXQXRXXNNERXXNXXXAGXRVTGCNTEHXXIGGGGYXPEASPQQXGDXSGXDWSGYGTHVGYSSSREXTEXXVXXXXR

SEQ ID NO: 804 - protein, 1383 aa, Homo sapiens
  SITE (1020)..(1020): Xaa at position 1020 is Phe, Tyr, Met, His, Ile, Leu Val, Ala, or Gly
  SITE (1022)..(1022): Xaa at position 1022 is Cys, Ala, Val, Gly, Ser, or Thr
  SITE (1024)..(1024): Xaa at position 1024 is Val, Ala, Gly, Leu, or Ile
  SITE (1032)..(1032): Xaa at position 1032 is Ile, Ala, Val, Leu, or Gly
  SITE (1034)..(1034): Xaa at position 1034 is Trp, Tyr, Phe, Met, His, Ile Leu, Val, Ala, or Gly
  SITE (1058)..(1058): Xaa at position 1058 is Cys, Ala, Val, Gly, Ser, or Thr
  SITE (1060)..(1060): Xaa at position 1060 is Leu, Ala, Val, Gly, or Ile
  SITE (1073)..(1073): Xaa at position 1073 is Tyr, Phe, Met, His, Ile, Leu Val, Ala, or Gly
  SITE (1075)..(1075): Xaa at position 1075 is Ile, Ala, Val, Leu, or Gly
  SITE (1077)..(1077): Xaa at position 1077 is Ala, Gly, or Pro
  SITE (1090)..(1090): Xaa at position 1090 is Leu, Ala, Val, Gly, or Ile
  SITE (1152)..(1152): Xaa at position 1152 is Cys, Ala, Val, Gly, Ser, or Thr
  SITE (1154)..(1154): Xaa at position 1154 is Met, Ile, Leu, Val, Ala, or Gly
  SITE (1156)..(1156): Xaa at position 1156 is Cys, Ala, Val, Gly, Ser, or Thr
  SITE (1158)..(1158): Xaa at position 1158 is Val, Ala, Gly, Leu, or Ile
  SITE (1193)..(1193): Xaa at position 1193 is Leu, Ala, Val, Gly, or Ile
  SITE (1195)..(1195): Xaa at position 1195 is Ile, Ala, Val, Leu, or Gly
  SITE (1198)..(1198): Xaa at position 1198 is Val, Ala, Gly, Leu, or Ile
  SITE (1206)..(1206): Xaa at position 1206 is Tyr, Phe, Met, His, Ile, Leu Val, Ala, or Gly
  SITE (1208)..(1208): Xaa at position 1208 is Cys, Ala, Val, Gly, Ser, or Thr
  SITE (1210)..(1210): Xaa at position 1210 is Ala, Gly, or Pro
  SITE (1253)..(1253): Xaa at position 1253 is Leu, Ala, Val, Gly, or Ile
  SITE (1255)..(1255): Xaa at position 1255 is Cys, Ala, Val, Gly, Ser, or Thr
  SITE (1267)..(1267): Xaa at position 1267 is Trp, Tyr, Phe, Met, His, Ile Leu, Val, Ala, or Gly
  SITE (1291)..(1291): Xaa at position 1291 is Ile, Ala, Val, Leu, or Gly
  SITE (1293)..(1293): Xaa at position 1293 is Leu, Ala, Val, Gly, or Ile
  SITE (1295)..(1295): Xaa at position 1295 is Ile, Ala, Val, Leu, or Gly
  SITE (1298)..(1298): Xaa at position 1298 is Ala, Gly, or Pro
  SITE (1306)..(1306): Xaa at position 1306 is Tyr, Phe, Met, His, Ile, Leu Val, Ala, or Gly
  SITE (1308)..(1308): Xaa at position 1308 is Val, Ala, Gly, Leu, or Ile
  SITE (1310)..(1310): Xaa at position 1310 is Ala, Gly, or Pro
MSGTSSHESFYDSLSDMQEESKNTDFFPGLSAFLSQEEINKSLDLARRAIADSETEDFDSEKEISQIFSTSPASLCEHPSHKETKLGEHASRRPQDNRSTPVQPLAEKQTKSISSPVSKRKPAMSPLLTRPSYIRSLRKAEKRGAKTPSTNVKPKTPHQRKGGPQSQLCDKAANLIEELTSIFKAAKPRNRSPNGESSSPDSGYLSPKNQPSALLSASASQSPMEDQGEMEREVKSPGARHCYQDNQDLAVPHNRKSHPQPHSALHFPAAPRFIQKLRSQEVAEGSRVYLECRVTGNPTPRVRWFCEGKELHNTPDIQIHCEGGDLHTLIIAEAFEDDTGRYTCLATNPSGSDTTSAEVFIEGASSTDSDSESLAFKSRAGAMPQAQKKTTSVSLTIGSSSPKTGVTTAVIQPLSVPVQQVHSPTSYLCRPDGTTTAYFPPVFTKELQNTAVAEGQVVVLECRVRGAPPLQVQWFRQGSEIQDSPDFRILQKKPRSTAEPEEICTLVIAETFPEDAGIFTCSARNDYGSATSTAQLVVTSANTENCSYESMGESNNDHFQHFPPPPPILETSSLELASKKPSEIQQVNNPELGLSRAALQMQFNAAERETNGVHPSRGVNGLINGKANSNKSLPTPAVLLSPTKEPPPLLAKPKLDPLKLQQLQNQIRLEQEAGARQPPPAPRSAPPSPPFPPPPAFPELAACTPPASPEPMSALASRSAPAMQSSGSFNYARPKQFIAAQNLGPASGHGTPASSPSSSSLPSPMSPTPRQFGRAPVPPFAQPFGAEPEAPWGSSSPSPPPPPPPVFSPTAAFPVPDVFPLPPPPPPLPSPGQASHCSSPATRFGHSQTPAAFLSALLPSQPPPAAVNALGLPKGVTPAGFPKKASRTARIASDEEIQGTKDAVIQDLERKLRFKEDLLNNGQPRLTYEERMARRLLGADSATVFNIQEPEEETANQEYKVSSCEQRLISEIEYRLERSPVDESGDEVQYGDVPVENGMAPFFEMKLKHYKIFEGMPVTXTXRXAGNPKPKXYXFKDGKQISPKSDHYTIQRDLDGTXSXHTTASTLDDDGNXTXMXANPQGRISCTGRXMVQAVNQRGRSPRSPSGHPHVRRPRSRSRDSGDENEPIQERFFRPHFLQAPGDLTVQEGKLXRXDXKXSGLPTPDLSWQLDGKPVRPDSAHKMLVRENGVHSXIXEPXTSRDAGIXTXIXTNRAGQNSFSLELVVAAKEAHKPPVFIEKLQNTGVADGYPVRXEXRVLGVPPPQIFXKKENESLTHSTDRVSMHQDNHGYXCXLXQGXTKEDAGWXTXSXKNEAGIVSCTARLDVYTQWHQQSQSTKPKKVRPSASRYAALSDQGLDIKAAFQPEANPSHLTLNTALVESEDL

SEQ ID NO: 805 - protein, 754 aa, Homo sapiens
  SITE (52)..(52): Xaa at position 52 is Cys, Ala, Val, Gly, Ser, or Thr
  SITE (59)..(59): Xaa at position 59 is Leu, Ala, Val, Gly, or Ile
MIVFLVFKHLFSLRLITMFFLLHFIVLINVKDFALTQGSMITPSCQKGYFPXGNLTKCXPRAFHCDGKDDCGNGADEENCGDTSGWATIFGTVHGNANSVALTQECFLKQYPQCCDCKETELECVNGDLKSVPMISNNVTLLSLKKNKIHSLPDKVFIKYTKLKKIFLQHNCIRHISRKAFFGLCNLQILYLNHNCITTLRPGIFKDLHQLTWLILDDNPITRISQRLFTGLNSLFFLSMVNNYLEALPKQMCAQMPQLNWVDLEGNRIKYLTNSTFLSCDSLTVLFLPRNQIGFVPEKTFSSLKNLGELDLSSNTITELSPHLFKDLKLLQKLNLSSNPLMYLHKNQFESLKQLQSLDLERIEIPNINTRMFQPMKNLSHIYFKNFRYCSYAPHVRICMPLTDGISSFEDLLANNILRIFVWVIAFITCFGNLFVIGMRSFIKAENTTHAMSIKILCCADCLMGVYLFFVGIFDIKYRGQYQKYALLWMESVQCRLMGFLAMLSTEVSVLLLTYLTLEKFLVIVFPFSNIRPGKRQTSVILICIWMAGFLIAVIPFWNKDYFGNFYGKNGVCFPLYYDQTEDIGSKGYSLGIFLGVNLLAFLIIVFSYITMFCSIQKTALQTTEVRNCFGREVAVANRFFFIVFSDAICWIPVFVVKILSLFRVEIPDTMTSWIVIFFLPVNSALNPILYTLTTNFFKDKLKQLLHKHQRKSIFKIKKKSLSTSIVWIEDSSSLKLGVLNKITLGDSIMKPVS

SEQ ID NO: 806 - protein, 6885 aa, Homo sapiens
  SITE (191)..(191): Xaa at position 191 is Ala, Gly, or Pro
  SITE (203)..(203): Xaa at position 203 is Val, Ala, Gly, Leu, or Ile
  SITE (210)..(210): Xaa at position 210 is Trp, Tyr, Phe, Met, His, Ile, Leu Val, Ala, or Gly
  SITE (215)..(215): Xaa at position 215 is Ala, Gly, or Pro
  SITE (216)..(216): Xaa at position 216 is Phe, Tyr, Met, His, Ile, Leu, Val Ala, or Gly
  SITE (218)..(218): Xaa at position 218 is Ala, Gly, or Pro
  SITE (219)..(219): Xaa at position 219 is Ile, Ala, Val, Leu, or Gly
  SITE (220)..(220): Xaa at position 220 is Ile, Ala, Val, Leu, or Gly
  SITE (242)..(242): Xaa at position 242 is Leu, Ala, Val, Gly, or Ile
  SITE (245)..(245): Xaa at position 245 is Ala, Gly, or Pro
  SITE (246)..(246): Xaa at position 246 is Phe, Tyr, Met, His, Ile, Leu, Val Ala, or Gly
  SITE (249)..(249): Xaa at position 249 is Ala, Gly, or Pro
  SITE (264)..(264): Xaa at position 264 is Val, Ala, Gly, Leu, or Ile
  SITE (274)..(274): Xaa at position 274 is Ile, Ala, Val, Leu, or Gly
  SITE (275)..(275): Xaa at position 275 is Met, Ile, Leu, Val, Ala, or Gly
  SITE (277)..(277): Xaa at position 277 is Tyr, Phe, Met, His, Ile, Leu, Val Ala, or Gly
  SITE (278)..(278): Xaa at position 278 is Val, Ala, Gly, Leu, or Ile
  SITE (279)..(279): Xaa at position 279 is Ala, Gly, or Pro
  SITE (281)..(281): Xaa at position 281 is Phe, Tyr, Met, His, Ile, Leu, Val Ala, or Gly
  SITE (282)..(282): Xaa at position 282 is Leu, Ala, Val, Gly, or Ile
MASSPELPTEDEQGSWGIDDLHISLQAEQEDTQKKAFTCWINSQLARHTSPSVISDLFTDIKKGHVLLDLLEVLSGQQLPRDKGSNTFQCRINIEHALTFLRNRSIKLINIHVTDIIDGNPSIILGLIWTIILHFHIEKLAQTLSCNYNQPSLDDVSVVDSSPASSPPAKKCSKVQARWQMSARKALLLWXQEQCATYESVNXTDFKSSXRNGMXXLXXXHALRPDLIDMKSVKHRSNKDNXREXXRIXEQELKIPRLLEPEDXDVVDPDEKSXXTXXXQXXQYSKDAPGTGEEAQGKVKDAMGWLTLQKEKLQKLLKDSENDTYFKKYNSLLSFMESFNEEKKSFLDVLSIKRDLDELDKDHLQLREAWDGLDHQINAWKIKLNYALPPPLHQTEAWLQEVEELMDEDLSASQDHSQAVTLIQEKMTLFKSLMDRFEHHSNILLTFENKDENHLPLVPPNKLEEMKRRINNILEKKFILLLEFHYYKCLVLGLVDEVKSKLDIWNIKYGSRESVELLLEDWHKFIEEKEFLARLDTSFQKCGEIYKNLAGECQNINKQYMMVKSDVCMYRKNIYNVKSTLQKVLACWATYVENLRLLRACFEETKKEEIKEVPFETLAQWNLEHATLNEAGNFLVEVSNDVVGSSISKELRRLNKRWRKLVSKTQLEMNLPLMIKKQDQPTFDNSGNILSKEEKATVEFSTDMSVELPENYNQNIKAGEKHEKENEEFTGQLKVAKDVEKLIGQVEIWEAEAKSVLDQDDVDTSMEESLKHLIAKGSMFDELMARSEDMLQMDIQNISSQESFQHVLTTGLQAKIQEAKEKVQINVVKLIAALKNLTDVSPDLDIRLKMEESQKELESYMMRAQQLLGQRESPGELISKHKEALIISNTKSLAKYLKAVEELKNNVTEDIKMSLEEKSRDVCAKWESLHHELSLYVQQLKIDIEKGKLSDNILKLEKQINKEKKLIRRGRTKGLIKEHEACFSEEGCLYQLNHHMEVLRELCEELPSQKSQQEVKRLLKDYEQKIERLLKCASEIHMTLQPTAGGTSKNEGTITTSENRGGDPHSEAPFAKSDNQPSTEKAMEPTMKFSLASVLRPLQEESIMEKDYSASINSLLERYDTYRDILEHHLQNNKFRITSDFSSEEDRSSSCLQAKLTDLQVIKNETDARWKEFEIISLKLENHVNDIKKPFVIKERDTLKERERELQMTLNTRMESLETALRLVLPVEKASLLLCGSDLPLHKMAIQGFHLIDADRIYQHLRNIQDSIAKQIEICNRLEEPGNFVLKELHPFDLHAMQNIILKYKTQFEGMNHRVQRSEDTLKALEDFLASLRTAKLSAEPVTDLSASDTQVAQENTLTVKNKEGEIHLMKDKAKHLDKCLKMLDMSFKDAERGDDTSCENLLDAFSIKLSETHGYGVQEEFTEENKLLEACIFKNNELLKNIQDVQSQISKIGLKDPTVPAVKHRKKSLIRLDKVLDEYEEEKRHLQEMANSLPHFKDGREKTVNQQCQNTVVLWENTKALVTECLEQCGRVLELLKQYQNFKSILTTLIQKEESVISLQASYMGKENLKKRIAEIEIVKEEFNEHLEVVDKINQVCKNLQFYLNKMKTFEEPPFEKEANIIVDRWLDINEKTEDYYENLGRALALWDKLFNLKNVIDEWTEKALQKMELHQLTEEDRERLKEELQVHEQKTSEFSRRVAEIQFLLQSSEIPLELQVMESSILNKMEHVQKCLTGESNCHALSGSTAELREDLDQAKTQIGMTESLLKALSPSDSLEIFTKLEEIQQQILQQKHSMILLENQIGCLTPELSELKKQYESVSDLFNTKKSVLQDHFSKLLNDQCKNFNDWFSNIKVNLKECFESSETKKSVEQKLQKLSDFLTLEGRNSKIKQVDSVLKHVKKHLPKAHVKELISWLVGQEFELEKMESICQARAKELEDSLQQLLRLQDDHRNLRKWLTNQEEKWKGMEEPGEKTELFCQALARKREQFESVAQLNNSLKEYGFTEEEEIIMEATCLMDRYQTLLRQLSEIEEEDKLLPTEDQSFNDLAHDVIHWIKEIKESLMVLNSSEGKMPLEERIQKIKEIILLKPEGDARIETIMKQAESSEAPLVQKTLTDISNQWDNTLHLASTYLSHQEKLLLEGEKYLQSKEDLRLMLIELKKKQEAGFALQHGLQEKKAQLKIYKKFLKKAQDLTSLLKELKSQGNYLLECTKNPSFSEEPWLEIKHLHESLLQQLQDSVQNLDGHVREHDSYQVCVTDLNTTLDNFSKEFVSFSDKPVDQIAVEEKLQKLQELENRLSLQDGTLKKILALAKSVKQNTSSVGQKIIKDDIKSLQCKQKDLENRLASAKQEMECCLNSILKSKRSTEKKGKFTLPGREKQATSDVQESTQESAAVEKLEEDWEINKDSAVEMAMSKQLSLNAQESMKNTEDERKVNELQNQPLELDTMLRNEQLEEIEKLYTQLEAKKAAIKPLEQTECLNKTETGALVLHNIGYSAQHLDNLLQALITLKKNKESQYCVLRDFQEYLAAVESSMKALLTDKESLKVGPLDSVTYLDKIKKFIASIEKEKDSLGNLKIKWENLSNHVTDMDKKLLESQIKQLEHGWEQVEQQIQKKYSQQVVEYDEFTTLMNKVQDTEISLQQQQQHLQLRLKSPEERAGNQSMIALTTDLQATKHGFSVLKGQAELQMKRIWGEKEKKNLEDGINNLKKQWETLEPLHLEAENQIKKCDIRNKMKETILWAKNLLGELNPSIPLLPDDILSQIRKCKVTHDGILARQQSVESLAEEVKDKVPSLTTYEGSDLNNTLEDLRNQYQMLVLKSTQRSQQLEFKLEERSNFFAIIRKFQLMVQESETLIIPRVETAATEAELKHHHVTLEASQKELQEIDSGISTHLQELTNIYEELNVFERLFLEDQLKNLKIRTNRIQRFIQNTCNEVEHKIKFCRQFHEKTSALQEEADSIQRNELLLNQEVNKGVKEEIYNLKDRLTAIKCCILQVLKLKKVFDYIGLNWDFSQLDQLQTQVFEKEKELEEKIKQLDTFEEEHGKYQALLSKMRAIDLQIKKMTEVVLKAPDSSPESRRLNAQILSQRIEKAKCLCDEIIKKLNENKTFDDSFKEKEILQIKLNAEENDKLYKVLQNMVLELSPKELDEKNCQDKLETSLHVLNQIKSQLQQPLLINLEIKHIQNEKDNCEAFQEQVWAEMCSIKAVTAIEKQREENSSEASDVETKLREFEDLQMQLNTSIDLRTNVLNDAYENLTRYKEAVTRAVESITSLEAIIIPYRVDVGNPEESLEMPLRKQEELESTVAHIQDLTEKLGMISSPEAKLQLQYTLQELVSKNSAMKEAFKAQETEAERYLENYKCYRKMEEDIYTNLSKMETVLGQSMSSLPLSYREALERLEQSKALVSNLISTKEELMKLRQILRLLRLRCTENDGICLLKIVSALWEKWLSLLEAAKEWEMWCEELKQEWKFVSEEIEREAIILDNLQEELPEISKTKEAATTEELSELLDCLCQYGENVEKQQLLLTLLLQRIRSIQNVPESSGAVETVPAFQEITSMKERCNKLLQKVQKNKELVQTEIQERHSFTKEIIALKNFFQQTTTSFQNMAFQDHPEKSEQFEELQSILKKGKLTFENIMEKLRIKYSEMYTIVPAEIESQVEECRKALEDIDEKISNEVLKSSPSYAMRRKIEEINNGLHNVEKMLQQKSKNIEKAQEIQKKMWDELDLWHSKLNELDSEVQDIVEQDPGQAQEWMDNLMIPFQQYQQVSQRAECRTSQLNKATVKMEEYSDLLKSTEAWIENTSHLLANPADYDSLRTLSHHASTVQMALEDSEQKHNLLHSIFMDLEDLSIIFETDELTQSIQELSNQVTALQQKIMESLPQIQRMADDVVAIESEVKSMEKRVSKIKTILLSKEIFDFSPEEHLKHGEVILENIRPMKKTIAEIVSYQVELRLPQTGMKPLPVFQRTNQLLQDIKLLENVTQEQNELLKVVIKQTNEWDEEIENLKQILNNYSAQFSLEHMSPDQADKLPQLQGEIERMEKQILSLNQRKEDLLVDLKATVLNLHQHLKQEQEGVERDRLPAVTSEEGGVAERDASERKLNRRGSMSYLAAVEEEVEESSVKSDNGDEKAEPSPQSWSSLWKHDKDMEEDRASSSSGTIVQEAYGKISTSDNSMAQILTPDSLNTEQGPECSLRPNQTEEGTTPPIEADTLDSSDAQGGLEPRVEKTRPEPTEVLHACKTQVAELELWLQQANVAVEPETLNADMQQVLEQQLVGCQAMLTEIEHKVAFLLETCKDQGLGDNGATQHEAEALSLKLKTVKCNLEKVQMMLQEKHSEDQHPTILKKSSEPEHQEALQPVNLSELESIVTERPQFSRQKDFQQQQVLELKPMEQKDFIKFIEFNAKKMWPQYCQHDNDTTQESSASNQASSPENDVPDSILSPQGQNGDKWQYLHHELSSKIKLPLPQLVEPQVSTNMGILPSVTMYNFRYPTTEELKTYTTQLEDLRQEASNLQTQENMTEEAYINLDKKLFELFLTLSQCLSSVEEMLEMPRLYREDGSGQQVHYETLALELKKLYLALSDKKGDLLKAMTWPGENTNLLLECFDNLQVCLEHTQAAAVCRSKSLKAGLDYNRSYQNEIKRLYHQLIKSKTSLQQSLNEISGQSVAEQLQKADAYTVELENAESRVAKLRDEGERLHLPYALLQEVYKLEDVLDSMWGMLRARYTELSSPFVTESQQDALLQGMVELVKIGKEKLAHGHLKQTKSKVALQAQIENHKVFFQKLVADMLLIQAYSAKILPSLLQNRETFWAEQVTEVKILEEKSRQCGMKLQSLLQKWEEFDENYASLEKDLEILISTLPSVSLVEETEERLVERISFYQQIKRNIGGKHARLYQTLNEGKQLVASVSCPELEGQIAKLEEQWLSLNKKIDHELHRLQALLKHLLSYNRDSDQLTKWLESSQHTLNYWKEQSLNVSQDLDTIRSNINNFFEFSKEVDEKSSLKTAVISIGNQLLHLKETDTATLRASLAQFEQKWTMLITQLPDIQEKLHQLQMEKLPSRKAITEMISWMNNVEHQTSDEDSVHSPSSASQVKHLLQKHKEFRMEMDYKQWIVDFVNQSLLQLSTCDVESKRYERTEFAEHLGEMNRQWHRVHGMLNRKIQHLEQLLESITESENKIQILNNWLEAQEERLKTLQKPESVISVQKLLLDCQDIENQLAIKSKALDELKQSYLTLESGAVPLLEDTASRIDELFQKRSSVLTQVNQLKTSMQSVLQEWKIYDQLYDEVNMMTIRFWYCMEHSKPVVLSLETLRCQVENLQSLQDEAESSEGSWEKLQEVIGKLKGLCPSVAEIIEEKCQNTHKRWTQVNQAIADQLQKAQSLLQLWKAYSNAHGEAAARLKQQEAKFQQLANISMSGNNLAEILPPALQDIKELQHDVQKTKEAFLQNSSVLDRLPQPAESSTHMLLPGPLHSLQRAAYLEKMLLVKANEFEFVLSQFKDFGVRLESLKGLIMHEEENLDRLHQQEKENPDSFLNHVLALTAQSPDIEHLNEVSLKLPLSDVAVKTLQNMNRQWIRATATALERCSELQGIGLNEKFLYCCEKWIQLLEKIEEALKVDVANSLPELLEQQKTYKMLEAEVSINQTIADSYVTQSLQLLDTTEIENRPEFITEFSKLTDRWQNAVQGVRQRKGDVDGLVRQWQDFTTSVENLFRFLTDTSHLLSAVKGQERFSLYQTRSLIHELKNKEIHFQRRRTTCALTLEAGEKLLLTTDLKTKESVGRRISQLQDSWKDMEPQLAEMIKQFQSTVETWDQCEKKIKELKSRLQVLKAQSEDPLPELHEDLHNEKELIKELEQSLASWTQNLKELQTMKADLTRHVLVEDVMVLKEQIEHLHRQWEDLCLRVAIRKQEIEDRLNTWVVFNEKNKELCAWLVQMENKVLQTADISIEEMIEKLQKDCMEEINLFSENKLQLKQMGDQLIKASNKSRAAEIDDKLNKINDRWQHLFDVIGSRVKKLKETFAFIQQLDKNMSNLRTWLARIESELSKPVVYDVCDDQEIQKRLAEQQDLQRDIEQHSAGVESVFNICDVLLHDSDACANETECDSIQQTTRSLDRRWRNICAMSMERRMKIEETWRLWQKFLDDYSRFEDWLKSAERTAACPNSSEVLYTSAKEELKRFEAFQRQIHERLTQLELINKQYRRLARENRTDTASRLKQMVHEGNQRWDNLQRRVTAVLRRLRHFTNQREEFEGTRESILVWLTEMDLQLTNVEHFSESDADDKMRQLNGFQQEITLNTNKIDQLIVFGEQLIQKSEPLDAVLIEDELEELHRYCQEVFGRVSRFHRRLTSCTPGLEDEKEASENETDMEDPREIQTDSWRKRGESEEPSSPQSLCHLVAPGHERSGCETPVSVDSIPLEWDHTGDVGGSSSHEEDEEGPYYSALSGKSISDGHSWHVPDSPSCPEHHYKQMEGDRNVPPVPPASSTPYKPPYGKLLLPPGTDGGKEGPRVLNGNPQQEDGGLAGITEQQSGAFDRWEMIQAQELHNKLKIKQNLQQLNSDISAITTWLKKTEAELEMLKMAKPPSDIQEIELRVKRLQEILKAFDTYKALVVSVNVSSKEFLQTESPESTELQSRLRQLSLLWEAAQGAVDSWRGGLRQSLMQCQDFHQLSQNLLLWLASAKNRRQKAHVTDPKADPRALLECRRELMQLEKELVERQPQVDMLQEISNSLLIKGHGEDCIEAEEKVHVIEKKLKQLREQVSQDLMALQGTQNPASPLPSFDEVDSGDQPPATSVPAPRAKQFRAVRTTEGEEETESRVPGSTRPQRSFLSRVVRAALPLQLLLLLLLLLACLLPSSEEDYSCTQANNFARSFYPMLRYTNGPPPT

SEQ ID NO: 807 - protein, 14507 aa, Homo sapiens
  SITE (14325)..(14325): Xaa at position 14325 is Leu, Ala, Val, Gly, or Ile
  SITE (14327)..(14327): Xaa at position 14327 is Phe, Tyr, Met, His, Ile, Leu Val, Ala, or Gly
  SITE (14329)..(14329): Xaa at position 14329 is Ile, Ala, Val, Leu, or Gly
  SITE (14332)..(14332): Xaa at position 14332 is Leu, Ala, Val, Gly, or Ile
  SITE (14353)..(14353): Xaa at position 14353 is Ile, Ala, Val, Leu, or Gly
  SITE (14357)..(14357): Xaa at position 14357 is Leu, Ala, Val, Gly, or Ile
  SITE (14360)..(14360): Xaa at position 14360 is Leu, Ala, Val, Gly, or Ile
  SITE (14389)..(14389): Xaa at position 14389 is Val, Ala, Gly, Leu, or Ile
  SITE (14393)..(14393): Xaa at position 14393 is Cys, Ala, Val, Gly, Ser, or Thr
  SITE (14399)..(14399): Xaa at position 14399 is Ala, Gly, or Pro
  SITE (14407)..(14407): Xaa at position 14407 is Ile, Ala, Val, Leu, or Gly
  SITE (14411)..(14411): Xaa at position 14411 is Phe, Tyr, Met, His, Ile, Leu Val, Ala, or Gly
  SITE (14421)..(14421): Xaa at position 14421 is Leu, Ala, Val, Gly, or Ile
  SITE (14431)..(14431): Xaa at position 14431 is Val, Ala, Gly, Leu, or Ile
MLKPSGLPGSSSPTRSLMTGSRSTKATPEMDSGLTGATLSPKTSTGAIVVTEHTLPFTSPDKTLASPTSSVVGRTTQSLGVMSSALPESTSRGMTHSEQRTSPSLSPQVNGTPSRNYPATSMVSGLSSPRTRTSSTEGNFTKEASTYTLTVETTSGPVTEKYTVPTETSTTEGDSTETPWDTRYIPVKITSPMKTFADSTASKENAPVSMTPAETTVTDSHTPGRTNPSFGTLYSSFLDLSPKGTPNSRGETSLELILSTTGYPFSSPEPGSAGHSRISTSAPLSSSASVLDNKISETSIFSGQSLTSPLSPGVPEARASTMPNSAIPFSMTLSNAETSAERVRSTISSLGTPSISTKQTAETILTFHAFAETMDIPSTHIAKTLASEWLGSPGTLGGTSTSALTTTSPSTTLVSEETNTHHSTSGKETEGTLNTSMTPLETSAPGEESEMTATLVPTLGFTTLDSKIRSPSQVSSSHPTRELRTTGSTSGRQSSSTAAHGSSDILRATTSSTSKASSWTSESTAQQFSEPQHTQWVETSPSMKTERPPASTSVAAPITTSVPSVVSGFTTLKTSSTKGIWLEETSADTLIGESTAGPTTHQFAVPTGISMTGGSSTRGSQGTTHLLTRATASSETSADLTLATNGVPVSVSPAVSKTAAGSSPPGGTKPSYTMVSSVIPETSSLQSSAFREGTSLGLTPLNTRHPFSSPEPDSAGHTKISTSIPLLSSASVLEDKVSATSTFSHHKATSSITTGTPEISTKTKPSSAVLSSMTLSNAATSPERVRNATSPLTHPSPSGEETAGSVLTLSTSAETTDSPNIHPTGTLTSESSESPSTLSLPSVSGVKTTFSSSTPSTHLFTSGEETEETSNPSVSQPETSVSRVRTTLASTSVPTPVFPTMDTWPTRSAQFSSSHLVSELRATSSTSVTNSTGSALPKISHLTGTATMSQTNRDTFNDSAAPQSTTWPETSPRFKTGLPSATTTVSTSATSLSATVMVSKFTSPATSSMEATSIREPSTTILTTETTNGPGSMAVASTNIPIGKGYITEGRLDTSHLPIGTTASSETSMDFTMAKESVSMSVSPSQSMDAAGSSTPGRTSQFVDTFSDDVYHLTSREITIPRDGTSSALTPQMTATHPPSPDPGSARSTWLGILSSSPSSPTPKVTMSSTFSTQRVTTSMIMDTVETSRWNMPNLPSTTSLTPSNIPTSGAIGKSTLVPLDTPSPATSLEASEGGLPTLSTYPESTNTPSIHLGAHASSESPSTIKLTMASVVKPGSYTPLTFPSIETHIHVSTARMAYSSGSSPEMTAPGETNTGSTWDPTTYITTTDPKDTSSAQVSTPHSVRTLRTTENHPKTESATPAAYSGSPKISSSPNLTSPATKAWTITDTTEHSTQLHYTKLAEKSSGFETQSAPGPVSVVIPTSPTIGSSTLELTSDVPGEPLVLAPSEQTTITLPMATWLSTSLTEEMASTDLDISSPSSPMSTFAIFPPMSTPSHELSKSEADTSAIRNTDSTTLDQHLGIRSLGRTGDLTTVPITPLTTTWTSVIEHSTQAQDTLSATMSPTHVTQSLKDQTSIPASASPSHLTEVYPELGTQGRSSSEATTFWKPSTDTLSREIETGPTNIQSTPPMDNTTTGSSSSGVTLGIAHLPIGTSSPAETSTNMALERRSSTATVSMAGTMGLLVTSAPGRSISQSLGRVSSVLSESTTEGVTDSSKGSSPRLNTQGNTALSSSLEPSYAEGSQMSTSIPLTSSPTTPDVEFIGGSTFWTKEVTTVMTSDISKSSARTESSSATLMSTALGSTENTGKEKLRTASMDLPSPTPSMEVTPWISLTLSNAPNTTDSLDLSHGVHTSSAGTLATDRSLNTGVTRASRLENGSDTSSKSLSMGNSTHTSMTYTEKSEVSSSIHPRPETSAPGAETTLTSTPGNRAISLTLPFSSIPVEEVISTGITSGPDINSAPMTHSPITPPTIVWTSTGTIEQSTQPLHAVSSEKVSVQTQSTPYVNSVAVSASPTHENSVSSGSSTSSPYSSASLESLDSTISRRNAITSWLWDLTTSLPTTTWPSTSLSEALSSGHSGVSNPSSTTTEFPLFSAASTSAAKQRNPETETHGPQNTAASTLNTDASSVTGLSETPVGASISSEVPLPMAITSRSDVSGLTSESTANPSLGTASSAGTKLTRTISLPTSESLVSFRMNKDPWTVSIPLGSHPTTNTETSIPVNSAGPPGLSTVASDVIDTPSDGAESIPTVSFSPSPDTEVTTISHFPEKTTHSFRTISSLTHELTSRVTPIPGDWMSSAMSTKPTGASPSITLGERRTITSAAPTTSPIVLTASFTETSTVSLDNETTVKTSDILDARKTNELPSDSSSSSDLINTSIASSTMDVTKTASISPTSISGMTASSSPSLFSSDRPQVPTSTTETNTATSPSVSSNTYSLDGGSNVGGTPSTLPPFTITHPVETSSALLAWSRPVRTFSTMVSTDTASGENPTSSNSVVTSVPAPGTWTSVGSTTDLPAMGFLKTSPAGEAHSLLASTIEPATAFTPHLSAAVVTGSSATSEASLLTTSESKAIHSSPQTPTTPTSGANWETSATPESLLVVTETSDTTLTSKILVTDTILFSTVSTPPSKFPSTGTLSGASFPTLLPDTPAIPLTATEPTSSLATSFDSTPLVTIASDSLGTVPETTLTMSETSNGDALVLKTVSNPDRSIPGITIQGVTESPLHPSSTSPSKIVAPRNTTYEGSITVALSTLPAGTTGSLVFSQSSENSETTALVDSSAGLERASVMPLTTGSQGMASSGGIRSGSTHSTGTKTFSSLPLTMNPGEVTAMSEITTNRLTATQSTAPKGIPVKPTSAESGLLTPVSASSSPSKAFASLTTAPPTWGIPQSTLTFEFSEVPSLDTKSASLPTPGQSLNTIPDSDASTASSSLSKSPEKNPRARMMTSTKAISASSFQSTGFTETPEGSASPSMAGHEPRVPTSGTGDPRYASESMSYPDPSKASSAMTSTSLASKLTTLFSTGQAARSGSSSSPISLSTEKETSFLSPTASTSRKTSLFLGPSMARQPNILVHLQTSALTLSPTSTLNMSQEEPPELTSSQTIAEEEGTTAETQTLTFTPSETPTSLLPVSSPTEPTARRKSSPETWASSISVPAKTSLVETTDGTLVTTIKMSSQAAQGNSTWPAPAEETGSSPAGTSPGSPEMSTTLKIMSSKEPSISPEIRSTVRNSPWKTPETTVPMETTVEPVTLQSTALGSGSTSISHLPTGTTSPTKSPTENMLATERVSLSPSPPEAWTNLYSGTPGGTRQSLATMSSVSLESPTARSITGTGQQSSPELVSKTTGMEFSMWHGSTGGTTGDTHVSLSTSSNILEDPVTSPNSVSSLTDKSKHKTETWVSTTAIPSTVLNNKIMAAEQQTSRSVDEAYSSTSSWSDQTSGSDITLGASPDVTNTLYITSTAQTTSLVSLPSGDQGITSLTNPSGGKTSSASSVTSPSIGLETLRANVSAVKSDIAPTAGHLSQTSSPAEVSILDVTTAPTPGISTTITTMGTNSISTTTPNPEVGMSTMDSTPATERRTTSTEHPSTWSSTAASDSWTVTDMTSNLKVARSPGTISTMHTTSFLASSTELDSMSTPHGRITVIGTSLVTPSSDASAVKTETSTSERTLSPSDTTASTPISTFSRVQRMSISVPDILSTSWTPSSTEAEDVPVSMVSTDHASTKTDPNTPLSTFLFDSLSTLDWDTGRSLSSATATTSAPQGATTPQELTLETMISPATSQLPFSIGHITSAVTPAAMARSSGVTFSRPDPTSKKAEQTSTQLPTTTSAHPGQVPRSAATTLDVIPHTAKTPDATFQRQGQTALTTEARATSDSWNEKEKSTPSAPWITEMMNSVSEDTIKEVTSSSSVLRTLNTLDINLESGTTSSPSWKSSPYERIAPSESTTDKEAIHPSTNTVETTGWVTSSEHASHSTIPAHSASSKLTSPVVTTSTREQAIVSMSTTTWPESTRARTEPNSFLTIELRDVSPYMDTSSTTQTSIISSPGSTAITKGPRTEITSSKRISSSFLAQSMRSSDSPSEAITRLSNFPAMTESGGMILAMQTSPPGATSLSAPTLDTSATASWTGTPLATTQRFTYSEKTTLFSKGPEDTSQPSPPSVEETSSSSSLVPIHATTSPSNILLTSQGHSPSSTPPVTSVFLSETSGLGKTTDMSRISLEPGTSLPPNLSSTAGEALSTYEASRDTKAIHHSADTAVTNMEATSSEYSPIPGHTKPSKATSPLVTSHIMGDITSSTSVFGSSETTEIETVSSVNQGLQERSTSQVASSATETSTVITHVSSGDATTHVTKTQATFSSGTSISSPHQFITSTNTFTDVSTNPSTSLIMTESSGVTITTQTGPTGAATQGPYLLDTSTMPYLTETPLAVTPDFMQSEKTTLISKGPKDVSWTSPPSVAETSYPSSLTPFLVTTIPPATSTLQGQHTSSPVSATSVLTSGLVKTTDMLNTSMEPVTNSPQNLNNPSNEILATLAATTDIETIHPSINKAVTNMGTASSAHVLHSTLPVSSEPSTATSPMVPASSMGDALASISIPGSETTDIEGEPTSSLTAGRKENSTLQEMNSTTESNIILSNVSVGAITEATKMEVPSFDATFIPTPAQSTKFPDIFSVASSRLSNSPPMTISTHMTTTQTGSSGATSKIPLALDTSTLETSAGTPSVVTEGFAHSKITTAMNNDVKDVSQTNPPFQDEASSPSSQAPVLVTTLPSSVAFTPQWHSTSSPVSMSSVLTSSLVKTAGKVDTSLETVTSSPQSMSNTLDDISVTSAATTDIETTHPSINTVVTNVGTTGSAFESHSTVSAYPEPSKVTSPNVTTSTMEDTTISRSIPKSSKTTRTETETTSSLTPKLRETSISQEITSSTETSTVPYKELTGATTEVSRTDVTSSSSTSFPGPDQSTVSLDISTETNTRLSTSPIMTESAEITITTQTGPHGATSQDTFTMDPSNTTPQAGIHSAMTHGFSQLDVTTLMSRIPQDVSWTSPPSVDKTSSPSSFLSSPAMTTPSLISSTLPEDKLSSPMTSLLTSGLVKITDILRTRLEPVTSSLPNFSSTSDKILATSKDSKDTKEIFPSINTEETNVKANNSGHESHSPALADSETPKATTQMVITTTVGDPAPSTSMPVHGSSETTNIKREPTYFLTPRLRETSTSQESSFPTDTSFLLSKVPTGTITEVSSTGVNSSSKISTPDHDKSTVPPDTFTGEIPRVFTSSIKTKSAEMTITTQASPPESASHSTLPLDTSTTLSQGGTHSTVTQGFPYSEVTTLMGMGPGNVSWMTTPPVEETSSVSSLMSSPAMTSPSPVSSTSPQSIPSSPLPVTALPTSVLVTTTDVLGTTSPESVTSSPPNLSSITHERPATYKDTAHTEAAMHHSTNTAVTNVGTSGSGHKSQSSVLADSETSKATPLMSTTSTLGDTSVSTSTPNISQTNQIQTEPTASLSPRLRESSTSEKTSSTTETNTAFSYVPTGAITQASRTEISSSRTSISDLDRPTIAPDISTGMITRLFTSPIMTKSAEMTVTTQTTTPGATSQGILPWDTSTTLFQGGTHSTVSQGFPHSEITTLRSRTPGDVSWMTTPPVEETSSGFSLMSPSMTSPSPVSSTSPESIPSSPLPVTALLTSVLVTTTNVLGTTSPEPVTSSPPNLSSPTQERLTTYKDTAHTEAMHASMHTNTAVANVGTSISGHESQSSVPADSHTSKATSPMGITFAMGDTSVSTSTPAFFETRIQTESTSSLIPGLRDTRTSEEINTVTETSTVLSEVPTTTTTEVSRTEVITSSRTTISGPDHSKMSPYISTETITRLSTFPFVTGSTEMAITNQTGPIGTISQATLTLDTSSTASWEGTHSPVTQRFPHSEETTTMSRSTKGVSWQSPPSVEETSSPSSPVPLPAITSHSSLYSAVSGSSPTSALPVTSLLTSGRRKTIDMLDTHSELVTSSLPSASSFSGEILTSEASTNTETIHFSENTAETNMGTTNSMHKLHSSVSIHSQPSGHTPPKVTGSMMEDAIVSTSTPGSPETKNVDRDSTSPLTPELKEDSTALVMNSTTESNTVFSSVSLDAATEVSRAEVTYYDPTFMPASAQSTKSPDISPEASSSHSNSPPLTISTHKTIATQTGPSGVTSLGQLTLDTSTIATSAGTPSARTQDFVDSETTSVMNNDLNDVLKTSPFSAEEANSLSSQAPLLVTTSPSPVTSTLQEHSTSSLVSVTSVPTPTLAKITDMDTNLEPVTRSPQNLRNTLATSEATTDTHTMHPSINTAVANVGTTSSPNEFYFTVSPDSDPYKATSAVVITSTSGDSIVSTSMPRSSAMKKIESETTFSLIFRLRETSTSQKIGSSSDTSTVFDKAFTAATTEVSRTELTSSSRTSIQGTEKPTMSPDTSTRSVTMLSTFAGLTKSEERTIATQTGPHRATSQGTLTWDTSITTSQAGTHSAMTHGFSQLDLSTLTSRVPEYISGTSPPSVEKTSSSSSLLSLPAITSPSPVPTTLPESRPSSPVHLTSLPTSGLVKTTDMLASVASLPPNLGSTSHKIPTTSEDIKDTEKMYPSTNIAVTNVGTTTSEKESYSSVPAYSEPPKVTSPMVTSFNIRDTIVSTSMPGSSEITRIEMESTFSLAHGLKGTSTSQDPIVSTEKSAVLHKLTTGATETSRTEVASSRRTSIPGPDHSTESPDISTEVIPSLPISLGITESSNMTIITRTGPPLGSTSQGTFTLDTPTTSSRAGTHSMATQEFPHSEMTTVMNKDPEILSWTIPPSIEKTSFSSSLMPSPAMTSPPVSSTLPKTIHTTPSPMTSLLTPSLVMTTDTLGTSPEPTTSSPPNLSSTSHEILTTDEDTTAIEAMHPSTSTAATNVETTSSGHGSQSSVLADSEKTKATAPMDTTSTMGHTTVSTSMSVSSETTKIKRESTYSLTPGLRETSISQNASFSTDTSIVLSEVPTGTTAEVSRTEVTSSGRTSIPGPSQSTVLPEISTRTMTRLFASPTMTESAEMTIPTQTGPSGSTSQDTLTLDTSTTKSQAKTHSTLTQRFPHSEMTTLMSRGPGDMSWQSSPSLENPSSLPSLLSLPATTSPPPISSTLPVTISSSPLPVTSLLTSSPVTTTDMLHTSPELVTSSPPKLSHTSDERLTTGKDTTNTEAVHPSTNTAASNVEIPSSGHESPSSALADSETSKATSPMFITSTQEDTTVAISTPHFLETSRIQKESISSLSPKLRETGSSVETSSAIETSAVLSEVSIGATTEISRTEVTSSSRTSISGSAESTMLPEISTTRKIIKFPTSPILAESSEMTIKTQTSPPGSTSESTFTLDTSTTPSLVITHSTMTQRLPHSEITTLVSRGAGDVPRPSSLPVEETSPPSSQLSLSAMISPSPVSSTLPASSHSSSASVTSLLTPGQVKTTEVLDASAEPETSSPPSLSSTSVEILATSEVTTDTEKIHPFSNTAVTKVGTSSSGHESPSSVLPDSETTKATSAMGTISIMGDTSVSTLTPALSNTRKIQSEPASSLTTRLRETSTSEETSLATEANTVLSKVSTGATTEVSRTEAISFSRTSMSGPEQSTMSQDISIGTIPRISASSVLTESAKMTITTQTGPSESTLESTLNLNTATTPSWVETHSIVIQGFPHPEMTTSMGRGPGGVSWPSPPFVKETSPPSSPLSLPAVTSPHPVSTTFLAHIPPSPLPVTSLLTSGPATTTDILGTSTEPGTSSSSSLSTTSHERLTTYKDTAHTEAVHPSTNTGGTNVATTSSGYKSQSSVLADSSPMCTTSTMGDTSVLTSTPAFLETRRIQTELASSLTPGLRESSGSEGTSSGTKMSTVLSKVPTGATTEISKEDVTSIPGPAQSTISPDISTRTVSWFSTSPVMTESAEITMNTHTSPLGATTQGTSTLDTSSTTSLTMTHSTISQGFSHSQMSTLMRRGPEDVSWMSPPLLEKTRPSFSLMSSPATTSPSPVSSTLPESISSSPLPVTSLLTSGLAKTTDMLHKSSEPVTNSPANLSSTSVEILATSEVTTDTEKTHPSSNRTVTDVGTSSSGHESTSFVLADSQTSKVTSPMVITSTMEDTSVSTSTPGFFETSRIQTEPTSSLTLGLRKTSSSEGTSLATEMSTVLSGVPTGATAEVSRTEVTSSSRTSISGFAQLTVSPETSTETITRLPTSSIMTESAEMMIKTQTDPPGSTPESTHTVDISTTPNWVETHSTVTQRFSHSEMTTLVSRSPGDMLWPSQSSVEETSSASSLLSLPATTSPSPVSSTLVEDFPSASLPVTSLLNPGLVITTDRMGISREPGTSSTSNLSSTSHERLTTLEDTVDTEDMQPSTHTAVTNVRTSISGHESQSSVLSDSETPKATSPMGTTYTMGETSVSISTSDFFETSRIQIEPTSSLTSGLRETSSSERISSATEGSTVLSEVPSGATTEVSRTEVISSRGTSMSGPDQFTISPDISTEAITRLSTSPIMTESAESAITIETGSPGATSEGTLTLDTSTTTFWSGTHSTASPGFSHSEMTTLMSRTPGDVPWPSLPSVEEASSVSSSLSSPAMTSTSFFSTLPESISSSPHPVTALLTLGPVKTTDMLRTSSEPETSSPPNLSSTSAEILATSEVTKDREKIHPSSNTPVVNVGTVIYKHLSPSSVLADLVTTKPTSPMATTSTLGNTSVSTSTPAFPETMMTQPTSSLTSGLREISTSQETSSATERSASLSGMPTGATTKVSRTEALSLGRTSTPGPAQSTISPEISTETITRISTPLTTTGSAEMTITPKTGHSGASSQGTFTLDTSSRASWPGTHSAATHRSPHSGMTTPMSRGPEDVSWPSRPSVEKTSPPSSLVSLSAVTSPSPLYSTPSESSHSSPLRVTSLFTPVMMKTTDMLDTSLEPVTTSPPSMNITSDESLATSKATMETEAIQLSENTAVTQMGTISARQEFYSSYPGLPEPSKVTSPVVTSSTIKDIVSTTIPASSEITRIEMESTSTLTPTPRETSTSQEIHSATKPSTVPYKALTSATIEDSMTQVMSSSRGPSPDQSTMSQDISTEVITRLSTSPIKTESTEMTITTQTGSPGATSRGTLTLDTSTTFMSGTHSTASQGFSHSQMTALMSRTPGDVPWLSHPSVEEASSASFSLSSPVMTSSSPVSSTLPDSIHSSSLPVTSLLTSGLVKTTELLGTSSEPETSSPPNLSSTSAEILAITEVTTDTEKLEMTNVVTSGYTHESPSSVLADSVTTKATSSMGITYPTGDTNVLTSTPAFSDTSRIQTKSKLSLTPGLMETSISEETSSATEKSTVLSSVPTGATTEVSRTEAISSSRTSIPGPAQSTMSSDTSMETITRISTPLTRKESTDMAITPKTGPSGATSQGTFTLDSSSTASWPGTHSATTQRFPQSVVTTPMSRGPEDVSWPSPLSVEKNSPPSSLVSSSSVTSPSPLYSTPSGSSHSSPVPVTSLFTSIMMKATDMLDASLEPETTSAPNMNITSDESLAASKATTETEAIHVFENTAASHVETTSATEELYSSSPGFSEPTKVISPVVTSSSIRDNMVSTTMPGSSGITRIEIESMSSLTPGLRETRTSQDITSSTETSTVLYKMPSGATPEVSRTEVMPSSRTSIPGPAQSTMSLDISDEVVTRLSTSPIMTESAEITITTQTGYSLATSQVTLPLGTSMTFLSGTHSTMSQGLSHSEMTNLMSRGPESLSWTSPRFVETTRSSSSLTSLPLTTSLSPVSSTLLDSSPSSPLPVTSLILPGLVKTTEVLDTSSEPKTSSSPNLSSTSVEIPATSEIMTDTEKIHPSSNTAVAKVRTSSSVHESHSSVLADSETTITIPSMGITSAVDDTTVFTSNPAFSETRRIPTEPTFSLTPGFRETSTSEETTSITETSAVLYGVPTSATTEVSMTEIMSSNRIHIPDSDQSTMSPDIITEVITRLSSSSMMSESTQMTITTQKSSPGATAQSTLTLATTTAPLARTHSTVPPRFLHSEMTTLMSRSPENPSWKSSLFVEKTSSSSSLLSLPVTTSPSVSSTLPQSIPSSSFSVTSLLTPGMVKTTDTSTEPGTSLSPNLSGTSVEILAASEVTTDTEKIHPSSSMAVTNVGTTSSGHELYSSVSIHSEPSKATYPVGTPSSMAETSISTSMPANFETTGFEAEPFSHLTSGFRKTNMSLDTSSVTPTNTPSSPGSTHLLQSSKTDFTSSAKTSSPDWPPASQYTEIPVDIITPFNASPSITESTGITSFPESRFTMSVTESTHHLSTDLLPSAETISTGTVMPSLSEAMTSFATTGVPRAISGSGSPFSRTESGPGDATLSTIAESLPSSTPVPFSSSTFTTTDSSTIPALHEITSSSATPYRVDTSLGTESSTTEGRLVMVSTLDTSSQPGRTSSSPILDTRMTESVELGTVTSAYQVPSLSTRLTRTDGIMEHITKIPNEAAHRGTIRPVKGPQTSTSPASPKGLHTGGTKRMETTTTALKTTTTALKTTSRATLTTSVYTPTLGTLTPLNASMQMASTIPTEMMITTPYVFPDVPETTSSLATSLGAETSTALPRTTPSVFNRESETTASLVSRSGAERSPVIQTLDVSSSEPDTTASWVIHPAETIPTVSKTTPNFFHSELDTVSSTATSHGADVSSAIPTNISPSELDALTPLVTISGTDTSTTFPTLTKSPHETETRTTWLTHPAETSSTIPRTIPNFSHHESDATPSIATSPGAETSSAIPIMTVSPGAEDLVTSQVTSSGTDRNMTIPTLTLSPGEPKTIASLVTHPEAQTSSAIPTSTISPAVSRLVTSMVTSLAAKTSTTNRALTNSPGEPATTVSLVTHPAQTSPTVPWTTSIFFHSKSDTTPSMTTSHGAESSSAVPTPTVSTEVPGVVTPLVTSSRAVISTTIPILTLSPGEPETTPSMATSHGEEASSAIPTPTVSPGVPGVVTSLVTSSRAVTSTTIPILTFSLGEPETTPSMATSHGTEAGSAVPTVLPEVPGMVTSLVASSRAVTSTTLPTLTLSPGEPETTPSMATSHGAEASSTVPTVSPEVPGVVTSLVTSSSGVNSTSIPTLILSPGELETTPSMATSHGAEASSAVPTPTVSPGVSGVVTPLVTSSRAVTSTTIPILTLSSSEPETTPSMATSHGVEASSAVLTVSPEVPGMVTSLVTSSRAVTSTTIPTLTISSDEPETTTSLVTHSEAKMISAIPTLAVSPTVQGLVTSLVTSSGSETSAFSNLTVASSQPETIDSWVAHPGTEASSVVPTLTVSTGEPFTNISLVTHPAESSSTLPRTTSRFSHSELDTMPSTVTSPEAESSSAISTTISPGIPGVLTSLVTSSGRDISATFPTVPESPHESEATASWVTHPAVTSTTVPRTTPNYSHSEPDTTPSIATSPGAEATSDFPTITVSPDVPDMVTSQVTSSGTDTSITIPTLTLSSGEPETTTSFITYSETHTSSAIPTLPVSPGASKMLTSLVISSGTDSTTTFPTLTETPYEPETTAIQLIHPAETNTMVPRTTPKFSHSKSDTTLPVAITSPGPEASSAVSTTTISPDMSDLVTSLVPSSGTDTSTTFPTLSETPYEPETTATWLTHPAETSTTVSGTIPNFSHRGSDTAPSMVTSPGVDTRSGVPTTTIPPSIPGVVTSQVTSSATDTSTAIPTLTPSPGEPETTASSATHPGTQTGFTVPIRTVPSSEPDTMASWVTHPPQTSTPVSRTTSSFSHSSPDATPVMATSPRTEASSAVLTTISPGAPEMVTSQITSSGAATSTTVPTLTHSPGMPETTALLSTHPRTETSKTFPASTVFPQVSETTASLTIRPGAETSTALPTQTTSSLFTLLVTGTSRVDLSPTASPGVSAKTAPLSTHPGTETSTMIPTSTLSLGLLETTGLLATSSSAETSTSTLTLTVSPAVSGLSSASITTDKPQTVTSWNTETSPSVTSVGPPEFSRTVTGTTMTLIPSEMPTPPKTSHGEGVSPTTILRTTMVEATNLATTGSSPTVAKTTTTFNTLAGSLFTPLTTPGMSTLASESVTSRTSYNHRSWISTTSSYNRRYWTPATSTPVTSTFSPGISTSSIPSSTAATVPFMVPFTLNFTITNLQYEEDMRHPGSRKFNATERELQGLLKPLFRNSSLEYLYSGCRLASLRPEKDSSATAVDAICTHRPDPEDLGLDRERLYWELSNLTNGIQELGPYTLDRNSLYVNGFTHRSSMPTTSTPGTSTVDVGTSGTPSSSPSPTTAGPLLMPFTLNFTITNLQYEEDMRRTGSRKFNTMESVLQGLLKPLFKNTSVGPLYSGCRLTLLRPEKDGAATGVDAICTHRLDPKSPGLNREQLYWELSKLTNDIEELGPYTLDRNSLYVNGFTHQSSVSTTSTPGTSTVDLRTSGTPSSLSSPTIMAAGPLLVPFTLNFTITNLQYGEDMGHPGSRKFNTTERVLQGLLGPIFKNTSVGPLYSGCRLTSLRSEKDGAATGVDAICIHHLDPKSPGLNRERLYWELSQLTNGIKELGPYTLDRNSLYVNGFTHRTSVPTSSTPGTSTVDLGTSGTPFSLPSPATAGPLLVLFTLNFTITNLKYEEDMHRPGSRKFNTTERVLQTLLGPMFKNTSVGLLYSGCRLTLLRSEKDGAATGVDAICTHRLDPKSPGVDREQLYWELSQLTNGIKELGPYTLDRNSLYVNGFTHWIPVPTSSTPGTSTVDLGSGTPSSLPSPTTAGPLLVPFTLNFTITNLKYEEDMHCPGSRKFNTTERVLQSLLGPMFKNTSVGPLYSGCRLTLLRSEKDGAATGVDAICTHRLDPKSPGVDREQLYWELSQLTNGIKELGPYTLDRNSLYVNGFTHQTSAPNTSTPGTSTVDLGTSGTPSSLPSPTSAGPLLVPFTLNFTITNLQYEEDMHHPGSRKFNTTERVLQGLLGPMFKNTSVGLLYSGCRLTLLRPEKNGAATGMDAICSHRLDPKSPGLNREQLYWELSQLTHGIKELGPYTLDRNSLYVNGFTHRSSVAPTSTPGTSTVDLGTSGTPSSLPSPTTAVPLLVPFTLNFTITNLQYGEDMRHPGSRKFNTTERVLQGLLGPLFKNSSVGPLYSGCRLISLRSEKDGAATGVDAICTHHLNPQSPGLDREQLYWQLSQMTNGIKELGPYTLDRNSLYVNGFTHRSSGLTTSTPWTSTVDLGTSGTPSPVPSPTTTGPLLVPFTLNFTITNLQYEENMGHPGSRKFNITESVLQGLLKPLFKSTSVGPLYSGCRLTLLRPEKDGVATRVDAICTHRPDPKIPGLDRQQLYWELSQLTHSITELGPYTLDRDSLYVNGFTQRSSVPTTSTPGTFTVQPETSETPSSLPGPTATGPVLLPFTLNFTITNLQYEEDMRRPGSRKFNTTERVLQGLLMPLFKNTSVSSLYSGCRLTLLRPEKDGAATRVDAVCTHRPDPKSPGLDRERLYWKLSQLTHGITELGPYTLDRHSLYVNGFTHQSSMTTTRTPDTSTMHLATSRTPASLSGPMTASPLLVLFTINFTITNLRYEENMHHPGSRKFNTTERVLQGLLRPVFKNTSVGPLYSGCRLTLLRPKKDGAATKVDAICTYRPDPKSPGLDREQLYWELSQLTHSITELGPYTLDRDSLYVNGFTQRSSVPTTSIPGTPTVDLGTSGTPVSKPGPSAASPLLVLFTLNFTITNLRYEENMQHPGSRKFNTTERVLQGLLRSLFKSTSVGPLYSGCRLTLLRPEKDGTATGVDAICTHHPDPKSPRLDREQLYWELSQLTHNITELGPYALDNDSLFVNGFTHRSSVSTTSTPGTPTVYLGASKTPASIFGPSAASHLLILFTLNFTITNLRYEENMWPGSRKFNTTERVLQGLLRPLFKNTSVGPLYSGCRLTLLRPEKDGEATGVDAICTHRPDPTGPGLDREQLYLELSQLTHSITELGPYTLDRDSLYVNGFTHRSSVPTTSTGVVSEEPFTLNFTINNLRYMADMGQPGSLKFNITDNVMQHLLSPLFQRSSLGARYTGCRVIALRSVKNGAETRVDLLCTYLQPLSGPGLPIKQVFHELSQQTHGITRLGPYSLDKDSLYLNGYNEPGPDEPPTTPKPATTFLPPLSEATTAMGYHLKTLTLNFTISNLQYSPDMGKGSATFNSTEGVLQHLLRPLFQKSSMGPFYLGCQLISLRPEKDGAATGVDTTCTYHPDPVGPGLDIQQLYWELSQLTHGVTQLGFYVLDRDSLFINGYAPQNLSIRGEYQINFHIVNWNLSNPDPTSSEYITLLRDIQDKVTTLYKGSQLHDTFRFCLVTNLTMDSVLVTVKALFSSNLDPSLVEQVFLDKTLNASFHWLGSTYQLVDIHVTEMESSVYQPTSSSSTQHFYXNXTXTNXPYSQDKAQPGTTNYQRNKRNXEDAXNQXFRNSSIKSYFSDCQVSTFRSVPNRHHTGXDSLXNFSPLXRRVDRVAXYEEXLRMTRNGTQXQNFTLDRSSXLVDGYSPNRNEPLTGNSDLPFWAVILIGLAGLLGVITCLICGVLVTTRRRKKEGEYNVQQQCPGYYQSHLDLEDLQ

SEQ ID NO: 808 - protein, 566 aa, Influenza A virus
  strain A/Hong Kong/1/1968 H3N2
  SITE (27)..(27): Xaa at position 27 is Ala, Gly, or Pro
  SITE (29)..(29): Xaa at position 29 is Leu, Ala, Val, Gly, or Ile
  SITE (30)..(30): Xaa at position 30 is Cys, Ala, Val, Gly, Ser, or Thr
  SITE (31)..(31): Xaa at position 31 is Leu, Ala, Val, Gly, or Ile
  SITE (35)..(35): Xaa at position 35 is Ala, Gly, or Pro
  SITE (42)..(42): Xaa at position 42 is Val, Ala, Gly, Leu, or Ile
  SITE (52)..(52): Xaa at position 52 is Val, Ala, Gly, Leu, or Ile
  SITE (58)..(58): Xaa at position 58 is Leu, Ala, Val, Gly, or Ile
  SITE (59)..(59): Xaa at position 59 is Val, Ala, Gly, Leu, or Ile
  SITE (67)..(67): Xaa at position 67 is Ile, Ala, Val, Leu, or Gly
  SITE (68)..(68): Xaa at position 68 is Cys, Ala, Val, Gly, Ser, or Thr
  SITE (74)..(74): Xaa at position 74 is Ile, Ala, Val, Leu, or Gly
  SITE (80)..(80): Xaa at position 80 is Cys, Ala, Val, Gly, Ser, or Thr
  SITE (82)..(82): Xaa at position 82 is Leu, Ala, Val, Gly, or Ile
  SITE (83)..(83): Xaa at position 83 is Ile, Ala, Val, Leu, or Gly
  SITE (85)..(85): Xaa at position 85 is Ala, Gly, or Pro
  SITE (86)..(86): Xaa at position 86 is Leu, Ala, Val, Gly, or Ile
  SITE (87)..(87): Xaa at position 87 is Leu, Ala, Val, Gly, or Ile
  SITE (92)..(92): Xaa at position 92 is Cys, Ala, Val, Gly, Ser, or Thr
  SITE (95)..(95): Xaa at position 95 is Phe, Tyr, Met, His, Ile, Leu, Val Ala, or Gly
  SITE (102)..(102): Xaa at position 102 is Leu, Ala, Val, Gly, or Ile
  SITE (103)..(103): Xaa at position 103 is Phe, Tyr, Met, His, Ile, Leu, Val Ala, or Gly
  SITE (104)..(104): Xaa at position 104 is Val, Ala, Gly, Leu, or Ile
  SITE (110)..(110): Xaa at position 110 is Phe, Tyr, Met, His, Ile, Leu, Val Ala, or Gly
  SITE (113)..(113): Xaa at position 113 is Cys, Ala, Val, Gly, Ser, or Thr
  SITE (114)..(114): Xaa at position 114 is Tyr, Phe, Met, His, Ile, Leu, Val Ala, or Gly
  SITE (116)..(116): Xaa at position 116 is Tyr, Phe, Met, His, Ile, Leu, Val Ala, or Gly
  SITE (121)..(121): Xaa at position 121 is Tyr, Phe, Met, His, Ile, Leu, Val Ala, or Gly
  SITE (122)..(122): Xaa at position 122 is Ala, Gly, or Pro
  SITE (124)..(124): Xaa at position 124 is Leu, Ala, Val, Gly, or Ile
  SITE (128)..(128): Xaa at position 128 is Val, Ala, Gly, Leu, or Ile
  SITE (129)..(129): Xaa at position 129 is Ala, Gly, or Pro
  SITE (134)..(134): Xaa at position 134 is Leu, Ala, Val, Gly, or Ile
  SITE (141)..(141): Xaa at position 141 is Phe, Tyr, Met, His, Ile, Leu, Val Ala, or Gly
  SITE (154)..(154): Xaa at position 154 is Ala, Gly, or Pro
  SITE (155)..(155): Xaa at position 155 is Cys, Ala, Val, Gly, Ser, or Thr
  SITE (163)..(163): Xaa at position 163 is Phe, Tyr, Met, His, Ile, Leu, Val Ala, or Gly
  SITE (164)..(164): Xaa at position 164 is Phe, Tyr, Met, His, Ile, Leu, Val Ala, or Gly
  SITE (167)..(167): Xaa at position 167 is Leu, Ala, Val, Gly, or Ile
  SITE (170)..(170): Xaa at position 170 is Leu, Ala, Val, Gly, or Ile
  SITE (177)..(177): Xaa at position 177 is Tyr, Phe, Met, His, Ile, Leu, Val Ala, or Gly
  SITE (180)..(180): Xaa at position 180 is Leu, Ala, Val, Gly, or Ile
  SITE (193)..(193): Xaa at position 193 is Leu, Ala, Val, Gly, or Ile
  SITE (194)..(194): Xaa at position 194 is Tyr, Phe, Met, His, Ile, Leu, Val Ala, or Gly
  SITE (195)..(195): Xaa at position 195 is Ile, Ala, Val, Leu, or Gly
  SITE (196)..(196): Xaa at position 196 is Trp, Tyr, Phe, Met, His, Ile, Leu Val, Ala, or Gly
  SITE (198)..(198): Xaa at position 198 is Val, Ala, Gly, Leu, or Ile
  SITE (199)..(199): Xaa at position 199 is His, Phe, Tyr, Lys, Arg, Gly, Ser Thr, Ala, Val, Leu, Ile, Asn, Met, or Gln
  SITE (200)..(200): Xaa at position 200 is His, Phe, Tyr, Lys, Arg, Gly, Ser Thr, Ala, Val, Leu, Ile, Asn, Met, or Gln
  SITE (211)..(211): Xaa at position 211 is Tyr, Phe, Met, His, Ile, Leu, Val Ala, or Gly
  SITE (218)..(218): Xaa at position 218 is Val, Ala, Gly, Leu, or Ile
  SITE (220)..(220): Xaa at position 220 is Val, Ala, Gly, Leu, or Ile
  SITE (246)..(246): Xaa at position 246 is Ile, Ala, Val, Leu, or Gly
  SITE (248)..(248): Xaa at position 248 is Ile, Ala, Val, Leu, or Gly
  SITE (249)..(249): Xaa at position 249 is Tyr, Phe, Met, His, Ile, Leu, Val Ala, or Gly
  SITE (252)..(252): Xaa at position 252 is Ile, Ala, Val, Leu, or Gly
  SITE (253)..(253): Xaa at position 253 is Val, Ala, Gly, Leu, or Ile
  SITE (258)..(258): Xaa at position 258 is Val, Ala, Gly, Leu, or Ile
  SITE (259)..(259): Xaa at position 259 is Leu, Ala, Val, Gly, or Ile
  SITE (261)..(261): Xaa at position 261 is Ile, Ala, Val, Leu, or Gly
  SITE (267)..(267): Xaa at position 267 is Leu, Ala, Val, Gly, or Ile
  SITE (268)..(268): Xaa at position 268 is Ile, Ala, Val, Leu, or Gly
  SITE (269)..(269): Xaa at position 269 is Ala, Gly, or Pro
  SITE (274)..(274): Xaa at position 274 is Phe, Tyr, Met, His, Ile, Leu, Val Ala, or Gly
  SITE (290)..(290): Xaa at position 290 is Ile, Ala, Val, Leu, or Gly
  SITE (297)..(297): Xaa at position 297 is Cys, Ala, Val, Gly, Ser, or Thr
  SITE (298)..(298): Xaa at position 298 is Ile, Ala, Val, Leu, or Gly
  SITE (304)..(304): Xaa at position 304 is Ile, Ala, Val, Leu, or Gly
  SITE (325)..(325): Xaa at position 325 is Val, Ala, Gly, Leu, or Ile
  SITE (332)..(332): Xaa at position 332 is Leu, Ala, Val, Gly, or Ile
  SITE (333)..(333): Xaa at position 333 is Ala, Gly, or Pro
  SITE (350)..(350): Xaa at position 350 is Ala, Gly, or Pro
  SITE (359)..(359): Xaa at position 359 is Trp, Tyr, Phe, Met, His, Ile, Leu Val, Ala, or Gly
  SITE (367)..(367): Xaa at position 367 is Tyr, Phe, Met, His, Ile, Leu, Val Ala, or Gly
  SITE (389)..(389): Xaa at position 389 is Ala, Gly, or Pro
  SITE (441)..(441): Xaa at position 441 is Ala, Gly, or Pro
  SITE (463)..(463): Xaa at position 463 is Leu, Ala, Val, Gly, or Ile
  SITE (471)..(471): Xaa at position 471 is Leu, Ala, Val, Gly, or Ile
  SITE (482)..(482): Xaa at position 482 is Cys, Ala, Val, Gly, Ser, or Thr
  SITE (483)..(483): Xaa at position 483 is Phe, Tyr, Met, His, Ile, Leu, Val Ala, or Gly
  SITE (485)..(485): Xaa at position 485 is Ile, Ala, Val, Leu, or Gly
  SITE (487)..(487): Xaa at position 487 is His, Phe, Tyr, Lys, Arg, Gly, Ser Thr, Ala, Val, Leu, Ile, Asn, Met, or Gln
  SITE (489)..(489): Xaa at position 489 is Cys, Ala, Val, Gly, Ser, or Thr
  SITE (493)..(493): Xaa at position 493 is Cys, Ala, Val, Gly, Ser, or Thr
  SITE (494)..(494): Xaa at position 494 is Ile, Ala, Val, Leu, or Gly
  SITE (497)..(497): Xaa at position 497 is Ile, Ala, Val, Leu, or Gly
  SITE (511)..(511): Xaa at position 511 is Ala, Gly, or Pro
MKTIIALSYIFCLALGQDLPGNDNSTXTXXXGHHXVPNGTLXKTITDDQIEXTNATEXXQSSSTGKXXNNPHRXLDGIDXTXXDXXXGDPHXDVXQNETWDXXXERSKAXSNXXPXDVPDXXSXRSLXXSSGTXEFITEGXTWTGVTQNGGSNXXKRGPGSGXXSRXNWXTKSGSTXPVXNVTMPNNDNFDKXXXXGXXXPSTNQEQTSLXVQASGRXTXSTRRSQQTIIPNIGSRPWVRGLSSRXSXXWTXXKPGDXXVXNSNGNXXXPRGYXKMRTGKSSIMRSDAPXDTCISEXXTPNGSXPNDKPFQNVNKITYGACPKYXKQNTLKXXTGMRNVPEKQTRGLFGXIAGFIENGXEGMIDGWXGFRHQNSEGTGQAADLKSTQAXIDQINGKLNRVIEKTNEKFHQIEKEFSEVEGRIQDLEKYVEDTKIDLWSYNXELLVALENQHTIDLTDSEMNKXFEKTRRQXRENAEDMGNGXXKXYXKXDNAXXESXRNGTYDHDVYRDEXLNNRFQIKGVELKSGYKDWILWISFAISCFLLCVVLLGFIMWACQRGNIRCNICI

SEQ ID NO: 809 - protein, 356 aa, Homo sapiens
  SITE (68)..(68): Xaa at position 68 is Trp, Tyr, Phe, Met, His, Ile, Leu Val, Ala, or Gly
  SITE (78)..(78): Xaa at position 78 is Phe, Tyr, Met, His, Ile, Leu, Val Ala, or Gly
  SITE (85)..(85): Xaa at position 85 is Cys, Ala, Val, Gly, Ser, or Thr
  SITE (86)..(86): Xaa at position 86 is Cys, Ala, Val, Gly, Ser, or Thr
  SITE (92)..(92): Xaa at position 92 is Phe, Tyr, Met, His, Ile, Leu, Val Ala, or Gly
  SITE (105)..(105): Xaa at position 105 is Met, Ile, Leu, Val, Ala, or Gly
  SITE (107)..(107): Xaa at position 107 is Tyr, Phe, Met, His, Ile, Leu, Val Ala, or Gly
  SITE (117)..(117): Xaa at position 117 is Ile, Ala, Val, Leu, or Gly
  SITE (138)..(138): Xaa at position 138 is Cys, Ala, Val, Gly, Ser, or Thr
  SITE (139)..(139): Xaa at position 139 is Ala, Gly, or Pro
  SITE (140)..(140): Xaa at position 140 is Val, Ala, Gly, Leu, or Ile
  SITE (141)..(141): Xaa at position 141 is Val, Ala, Gly, Leu, or Ile
  SITE (146)..(146): Xaa at position 146 is Ile, Ala, Val, Leu, or Gly
  SITE (147)..(147): Xaa at position 147 is Leu, Ala, Val, Gly, or Ile
  SITE (152)..(152): Xaa at position 152 is Cys, Ala, Val, Gly, Ser, or Thr
  SITE (156)..(156): Xaa at position 156 is Ile, Ala, Val, Leu, or Gly
  SITE (161)..(161): Xaa at position 161 is Phe, Tyr, Met, His, Ile, Leu, Val Ala, or Gly
  SITE (162)..(162): Xaa at position 162 is Val, Ala, Gly, Leu, or Ile
  SITE (165)..(165): Xaa at position 165 is Cys, Ala, Val, Gly, Ser, or Thr
  SITE (167)..(167): Xaa at position 167 is Leu, Ala, Val, Gly, or Ile
  SITE (178)..(178): Xaa at position 178 is Val, Ala, Gly, Leu, or Ile
  SITE (184)..(184): Xaa at position 184 is Leu, Ala, Val, Gly, or Ile
  SITE (185)..(185): Xaa at position 185 is Val, Ala, Gly, Leu, or Ile
  SITE (191)..(191): Xaa at position 191 is Ile, Ala, Val, Leu, or Gly
  SITE (192)..(192): Xaa at position 192 is Ile, Ala, Val, Leu, or Gly
  SITE (199)..(199): Xaa at position 199 is Leu, Ala, Val, Gly, or Ile
  SITE (206)..(206): Xaa at position 206 is Phe, Tyr, Met, His, Ile, Leu, Val Ala, or Gly
  SITE (213)..(213): Xaa at position 213 is Tyr, Phe, Met, His, Ile, Leu, Val Ala, or Gly
  SITE (222)..(222): Xaa at position 222 is Ala, Gly, or Pro
  SITE (223)..(223): Xaa at position 223 is Phe, Tyr, Met, His, Ile, Leu, Val Ala, or Gly
  SITE (233)..(233): Xaa at position 233 is Leu, Ala, Val, Gly, or Ile
  SITE (235)..(235): Xaa at position 235 is Val, Ala, Gly, Leu, or Ile
  SITE (236)..(236): Xaa at position 236 is Tyr, Phe, Met, His, Ile, Leu, Val Ala, or Gly
  SITE (239)..(239): Xaa at position 239 is Leu, Ala, Val, Gly, or Ile
  SITE (244)..(244): Xaa at position 244 is Ala, Gly, or Pro
  SITE (262)..(262): Xaa at position 262 is Phe, Tyr, Met, His, Ile, Leu, Val Ala, or Gly
  SITE (263)..(263): Xaa at position 263 is Trp, Tyr, Phe, Met, His, Ile, Leu Val, Ala, or Gly
  SITE (270)..(270): Xaa at position 270 is Ala, Gly, or Pro
  SITE (273)..(273): Xaa at position 273 is Leu, Ala, Val, Gly, or Ile
  SITE (282)..(282): Xaa at position 282 is Ala, Gly, or Pro
  SITE (283)..(283): Xaa at position 283 is Ala, Gly, or Pro
  SITE (284)..(284): Xaa at position 284 is Leu, Ala, Val, Gly, or Ile
  SITE (286)..(286): Xaa at position 286 is Leu, Ala, Val, Gly, or Ile
  SITE (287)..(287): Xaa at position 287 is Cys, Ala, Val, Gly, Ser, or Thr
  SITE (290)..(290): Xaa at position 290 is Val, Ala, Gly, Leu, or Ile
  SITE (293)..(293): Xaa at position 293 is Tyr, Phe, Met, His, Ile, Leu, Val Ala, or Gly
  SITE (296)..(296): Xaa at position 296 is Trp, Tyr, Phe, Met, His, Ile, Leu Val, Ala, or Gly
  SITE (298)..(298): Xaa at position 298 is Phe, Tyr, Met, His, Ile, Leu, Val Ala, or Gly
  SITE (307)..(307): Xaa at position 307 is Ile, Ala, Val, Leu, or Gly
  SITE (311)..(311): Xaa at position 311 is Tyr, Phe, Met, His, Ile, Leu, Val Ala, or Gly
  SITE (312)..(312): Xaa at position 312 is Tyr, Phe, Met, His, Ile, Leu, Val Ala, or Gly
  SITE (316)..(316): Xaa at position 316 is Leu, Ala, Val, Gly, or Ile
  SITE (321)..(321): Xaa at position 321 is Phe, Tyr, Met, His, Ile, Leu, Val Ala, or Gly
  SITE (323)..(323): Xaa at position 323 is Ala, Gly, or Pro
  SITE (324)..(324): Xaa at position 324 is Met, Ile, Leu, Val, Ala, or Gly
  SITE (334)..(334): Xaa at position 334 is Leu, Ala, Val, Gly, or Ile
  SITE (340)..(340): Xaa at position 340 is Leu, Ala, Val, Gly, or Ile
  SITE (347)..(347): Xaa at position 347 is Cys, Ala, Val, Gly, Ser, or Thr
MSPCGRARRQTSRGAMAVLAWKFPRTRLPMGASALCVVVLCWLYIFPVYRLPNEKEIVQGVLQQGTAXRRNQTAARAXRKQMEDXXDPAHLXAMTKMNSPMGKSXWXDGEFLYSFTXDNSTYSLFPQATPFQLPLKKXXXXGNGGXXKKSGXGRQXDEANXXMRXNXPPLSSEYTKDXGSKSQXXTANPSXXRQRFQNXLWSRKTXVDNMKIXNHSYIYMPXXSMKTGTEPSXRXXYTXSDVGXNQTVLFANPNFLRSIGKXXKSRGIHXKRXSTGLFLVSXXXGXXEEXAIXGFXPXSVNMHEQPXSHHXXDNVXPFSGXHXXPEEFLQLWYXHKIGAXRMQLDPXEDTSLQPTS

SEQ ID NO: 810 - protein, 709 aa, Homo sapiens
  SITE (50)..(50): Xaa at position 50 is Cys, Ala, Val, Gly, Ser, or Thr
  SITE (53)..(53): Xaa at position 53 is Leu, Ala, Val, Gly, or Ile
  SITE (54)..(54): Xaa at position 54 is Leu, Ala, Val, Gly, or Ile
  SITE (62)..(62): Xaa at position 62 is Cys, Ala, Val, Gly, Ser, or Thr
  SITE (73)..(73): Xaa at position 73 is Ile, Ala, Val, Leu, or Gly
  SITE (85)..(85): Xaa at position 85 is Val, Ala, Gly, Leu, or Ile
  SITE (95)..(95): Xaa at position 95 is Met, Ile, Leu, Val, Ala, or Gly
  SITE (96)..(96): Xaa at position 96 is Val, Ala, Gly, Leu, or Ile
  SITE (98)..(98): Xaa at position 98 is Leu, Ala, Val, Gly, or Ile
  SITE (103)..(103): Xaa at position 103 is Phe, Tyr, Met, His, Ile, Leu, Val Ala, or Gly
  SITE (108)..(108): Xaa at position 108 is Met, Ile, Leu, Val, Ala, or Gly
  SITE (111)..(111): Xaa at position 111 is Leu, Ala, Val, Gly, or Ile
  SITE (121)..(121): Xaa at position 121 is Leu, Ala, Val, Gly, or Ile
  SITE (122)..(122): Xaa at position 122 is Ala, Gly, or Pro
  SITE (123)..(123): Xaa at position 123 is Val, Ala, Gly, Leu, or Ile
  SITE (164)..(164): Xaa at position 164 is Trp, Tyr, Phe, Met, His, Ile, Leu Val, Ala, or Gly
  SITE (171)..(171): Xaa at position 171 is Leu, Ala, Val, Gly, or Ile
  SITE (176)..(176): Xaa at position 176 is Phe, Tyr, Met, His, Ile, Leu, Val Ala, or Gly
  SITE (178)..(178): Xaa at position 178 is Phe, Tyr, Met, His, Ile, Leu, Val Ala, or Gly
  SITE (180)..(180): Xaa at position 180 is Ile, Ala, Val, Leu, or Gly
  SITE (181)..(181): Xaa at position 181 is Phe, Tyr, Met, His, Ile, Leu, Val Ala, or Gly
  SITE (182)..(182): Xaa at position 182 is Leu, Ala, Val, Gly, or Ile
  SITE (183)..(183): Xaa at position 183 is Leu, Ala, Val, Gly, or Ile
  SITE (191)..(191): Xaa at position 191 is Val, Ala, Gly, Leu, or Ile
  SITE (192)..(192): Xaa at position 192 is Ile, Ala, Val, Leu, or Gly
  SITE (212)..(212): Xaa at position 212 is Leu, Ala, Val, Gly, or Ile
  SITE (213)..(213): Xaa at position 213 is Cys, Ala, Val, Gly, Ser, or Thr
  SITE (214)..(214): Xaa at position 214 is Ala, Gly, or Pro
  SITE (215)..(215): Xaa at position 215 is Met, Ile, Leu, Val, Ala, or Gly
  SITE (217)..(217): Xaa at position 217 is Leu, Ala, Val, Gly, or Ile
  SITE (230)..(230): Xaa at position 230 is Cys, Ala, Val, Gly, Ser, or Thr
  SITE (248)..(248): Xaa at position 248 is Cys, Ala, Val, Gly, Ser, or Thr
  SITE (251)..(251): Xaa at position 251 is Leu, Ala, Val, Gly, or Ile
  SITE (256)..(256): Xaa at position 256 is Val, Ala, Gly, Leu, or Ile
  SITE (257)..(257): Xaa at position 257 is Trp, Tyr, Phe, Met, His, Ile, Leu Val, Ala, or Gly
  SITE (259)..(259): Xaa at position 259 is Met, Ile, Leu, Val, Ala, or Gly
  SITE (275)..(275): Xaa at position 275 is Val, Ala, Gly, Leu, or Ile
  SITE (276)..(276): Xaa at position 276 is Val, Ala, Gly, Leu, or Ile
  SITE (277)..(277): Xaa at position 277 is Val, Ala, Gly, Leu, or Ile
  SITE (278)..(278): Xaa at position 278 is Ala, Gly, or Pro
  SITE (279)..(279): Xaa at position 279 is Ala, Gly, or Pro
  SITE (282)..(282): Xaa at position 282 is Leu, Ala, Val, Gly, or Ile
  SITE (288)..(288): Xaa at position 288 is Phe, Tyr, Met, His, Ile, Leu, Val Ala, or Gly
  SITE (292)..(292): Xaa at position 292 is Ala, Gly, or Pro
  SITE (295)..(295): Xaa at position 295 is Ala, Gly, or Pro
  SITE (298)..(298): Xaa at position 298 is Ala, Gly, or Pro
  SITE (299)..(299): Xaa at position 299 is Val, Ala, Gly, Leu, or Ile
  SITE (300)..(300): Xaa at position 300 is Ala, Gly, or Pro
  SITE (302)..(302): Xaa at position 302 is Phe, Tyr, Met, His, Ile, Leu, Val Ala, or Gly
  SITE (303)..(303): Xaa at position 303 is Val, Ala, Gly, Leu, or Ile
  SITE (306)..(306): Xaa at position 306 is Leu, Ala, Val, Gly, or Ile
  SITE (307)..(307): Xaa at position 307 is Ala, Gly, or Pro
  SITE (308)..(308): Xaa at position 308 is Ala, Gly, or Pro
  SITE (309)..(309): Xaa at position 309 is Ala, Gly, or Pro
  SITE (311)..(311): Xaa at position 311 is Ala, Gly, or Pro
  SITE (312)..(312): Xaa at position 312 is Leu, Ala, Val, Gly, or Ile
  SITE (315)..(315): Xaa at position 315 is Ala, Gly, or Pro
  SITE (325)..(325): Xaa at position 325 is Val, Ala, Gly, Leu, or Ile
  SITE (326)..(326): Xaa at position 326 is Met, Ile, Leu, Val, Ala, or Gly
  SITE (327)..(327): Xaa at position 327 is Phe, Tyr, Met, His, Ile, Leu, Val Ala, or Gly
  SITE (328)..(328): Xaa at position 328 is Val, Ala, Gly, Leu, or Ile
  SITE (329)..(329): Xaa at position 329 is Phe, Tyr, Met, His, Ile, Leu, Val Ala, or Gly
  SITE (330)..(330): Xaa at position 330 is Phe, Tyr, Met, His, Ile, Leu, Val Ala, or Gly
  SITE (335)..(335): Xaa at position 335 is Phe, Tyr, Met, His, Ile, Leu, Val Ala, or Gly
  SITE (337)..(337): Xaa at position 337 is Tyr, Phe, Met, His, Ile, Leu, Val Ala, or Gly
  SITE (338)..(338): Xaa at position 338 is Ile, Ala, Val, Leu, or Gly
  SITE (347)..(347): Xaa at position 347 is Met, Ile, Leu, Val, Ala, or Gly
  SITE (354)..(354): Xaa at position 354 is Val, Ala, Gly, Leu, or Ile
  SITE (362)..(362): Xaa at position 362 is Phe, Tyr, Met, His, Ile, Leu, Val Ala, or Gly
  SITE (365)..(365): Xaa at position 365 is Leu, Ala, Val, Gly, or Ile
  SITE (368)..(368): Xaa at position 368 is Val, Ala, Gly, Leu, or Ile
  SITE (376)..(376): Xaa at position 376 is Leu, Ala, Val, Gly, or Ile
  SITE (378)..(378): Xaa at position 378 is Met, Ile, Leu, Val, Ala, or Gly
  SITE (394)..(394): Xaa at position 394 is Val, Ala, Gly, Leu, or Ile
  SITE (397)..(397): Xaa at position 397 is Leu, Ala, Val, Gly, or Ile
  SITE (401)..(401): Xaa at position 401 is Leu, Ala, Val, Gly, or Ile
  SITE (430)..(430): Xaa at position 430 is Phe, Tyr, Met, His, Ile, Leu, Val Ala, or Gly
  SITE (439)..(439): Xaa at position 439 is Val, Ala, Gly, Leu, or Ile
  SITE (441)..(441): Xaa at position 441 is Leu, Ala, Val, Gly, or Ile
  SITE (442)..(442): Xaa at position 442 is Ala, Gly, or Pro
  SITE (471)..(471): Xaa at position 471 is Leu, Ala, Val, Gly, or Ile
  SITE (484)..(484): Xaa at position 484 is Ala, Gly, or Pro
  SITE (487)..(487): Xaa at position 487 is Leu, Ala, Val, Gly, or Ile
  SITE (488)..(488): Xaa at position 488 is Ala, Gly, or Pro
  SITE (490)..(490): Xaa at position 490 is Val, Ala, Gly, Leu, or Ile
  SITE (491)..(491): Xaa at position 491 is Ala, Gly, or Pro
  SITE (493)..(493): Xaa at position 493 is Val, Ala, Gly, Leu, or Ile
  SITE (494)..(494): Xaa at position 494 is Leu, Ala, Val, Gly, or Ile
  SITE (498)..(498): Xaa at position 498 is Leu, Ala, Val, Gly, or Ile
  SITE (499)..(499): Xaa at position 499 is Tyr, Phe, Met, His, Ile, Leu, Val Ala, or Gly
  SITE (501)..(501): Xaa at position 501 is Leu, Ala, Val, Gly, or Ile
  SITE (502)..(502): Xaa at position 502 is Ala, Gly, or Pro
  SITE (511)..(511): Xaa at position 511 is Val, Ala, Gly, Leu, or Ile
  SITE (513)..(513): Xaa at position 513 is Ala, Gly, or Pro
  SITE (518)..(518): Xaa at position 518 is Val, Ala, Gly, Leu, or Ile
  SITE (521)..(521): Xaa at position 521 is Leu, Ala, Val, Gly, or Ile
  SITE (522)..(522): Xaa at position 522 is Leu, Ala, Val, Gly, or Ile
  SITE (525)..(525): Xaa at position 525 is Phe, Tyr, Met, His, Ile, Leu, Val Ala, or Gly
  SITE (529)..(529): Xaa at position 529 is Ala, Gly, or Pro
  SITE (534)..(534): Xaa at position 534 is Phe, Tyr, Met, His, Ile, Leu, Val Ala, or Gly
  SITE (538)..(538): Xaa at position 538 is Leu, Ala, Val, Gly, or Ile
  SITE (553)..(553): Xaa at position 553 is His, Phe, Tyr, Lys, Arg, Gly, Ser Thr, Ala, Val, Leu, Ile, Asn, Met, or Gln
  SITE (555)..(555): Xaa at position 555 is Ile, Ala, Val, Leu, or Gly
  SITE (566)..(566): Xaa at position 566 is Val, Ala, Gly, Leu, or Ile
  SITE (567)..(567): Xaa at position 567 is Val, Ala, Gly, Leu, or Ile
  SITE (570)..(570): Xaa at position 570 is Ala, Gly, or Pro
  SITE (571)..(571): Xaa at position 571 is Leu, Ala, Val, Gly, or Ile
  SITE (605)..(605): Xaa at position 605 is Val, Ala, Gly, Leu, or Ile
  SITE (620)..(620): Xaa at position 620 is Cys, Ala, Val, Gly, Ser, or Thr
  SITE (628)..(628): Xaa at position 628 is Ala, Gly, or Pro
  SITE (630)..(630): Xaa at position 630 is Ala, Gly, or Pro
  SITE (634)..(634): Xaa at position 634 is Ala, Gly, or Pro
  SITE (658)..(658): Xaa at position 658 is Ala, Gly, or Pro
  SITE (660)..(660): Xaa at position 660 is Ile, Ala, Val, Leu, or Gly
MATAGGGSGADPGSRGLLRLLSFCVLLAGLCRGNSVERKIYIPLNKTAPXVRXXNATHQIGXQSSISGDTGVXHVVEKEEDLQWXLTDGPNPPYXXLXESKHXTRDLXEKXKGRTSRIAGXXXSLTKPSPASGFSPSVQCPNDGFGVYSNSYGPEFAHCREIQXNSLGNGXAYEDXSXPXXXXEDENETKXXKQCYQDHNLSQNGSAPTFPXXXXQXFSHMHAVISTATXMRRSSIQSTFSINPEIVXDPXSDYNXXSXLKPINTTGTLKPDDRXXXXXTRXDSRSFXWNVXPGXESXXXSXXTQXXXXEXXQKXPDVTTLPRNXXXXXXQGETXDXXGSSRMVYDXEKGKFPXQLENVDSXVEXGQXALRTSLEXWXHTDPVSQKNESVRNQXEDXLATXEKSGAGVPAVILRRPNQSQPLPPSSLQRXLRARNISGXVXXDHSGAFHNKYYQSIYDTAENINVSYPEWXSPEEDLNFVTDTXKAXXDXXTXXGRAXXEXXGGTNFSDTXQXDPQTXTRXXYGXLIKXNNSWXQSIXRQDLRSYLGDGPLQXYXAVSSPTNTTYXXQYXXANLTGTVVNLTREQCQDPSKVPSENKDLYEYSWXQGPLHSNETDRLPRXVRSTARLXRXLSPXFELSQWSSTEYSTWTESRWKDIRXRXFLIASKELELITLTVGFGILIFSLIVTYCINAKADVLFIAPREPGAVSY

SEQ ID NO: 811 - protein, 394 aa, Homo sapiens
  SITE (73)..(73): Xaa at position 73 is Tyr, Phe, Met, His, Ile, Leu, Val Ala, or Gly
  SITE (92)..(92): Xaa at position 92 is Cys, Ala, Val, Gly, Ser, or Thr
  SITE (119)..(119): Xaa at position 119 is Ala, Gly, or Pro
  SITE (145)..(145): Xaa at position 145 is Ile, Ala, Val, Leu, or Gly
  SITE (183)..(183): Xaa at position 183 is Trp, Tyr, Phe, Met, His, Ile, Leu Val, Ala, or Gly
  SITE (214)..(214): Xaa at position 214 is His, Phe, Tyr, Lys, Arg, Gly, Ser Thr, Ala, Val, Leu, Ile, Asn, Met, or Gln
  SITE (284)..(284): Xaa at position 284 is Leu, Ala, Val, Gly, or Ile
MSREMQDVDLAEVKPLVEKGETITGLLQEFDVQEQDIETLHGSVHVTLCGTPKGNRPVILTYHDIGMNHKTCXNPLFNYEDMQEITQHFAVXHVDAPGQQDGAASFPAGYMYPSMDQLXEMLPGVLQQFGLKSIIGMGTGAGAYXLTRFALNNPEMVEGLVLINVNPCAEGWMDWAASKISGXTQALPDMVVSHLFGKEEMQSNVEVVHTYRQXIVNDMNPGNLHLFINAYNSRRDLEIERPMPGTHTVTLQCPALLVVGDSSPAVDAVVECNSKLDPTKTTLXKMADCGGLPQISQPAKLAEAFKYFVQGMGYMPSASMTRLMRSRTASGSSVTSLDGTRSRSHTSEGTRSRSHTSEGTRSRSHTSEGAHLDITPNSGAAGNSAGPKSMEVSC

SEQ ID NO: 812 - protein, 538 aa, Homo sapiens
  SITE (52)..(52): Xaa at position 52 is Leu, Ala, Val, Gly, or Ile
  SITE (54)..(54): Xaa at position 54 is Cys, Ala, Val, Gly, Ser, or Thr
  SITE (68)..(68): Xaa at position 68 is Val, Ala, Gly, Leu, or Ile
  SITE (70)..(70): Xaa at position 70 is Trp, Tyr, Phe, Met, His, Ile, Leu Val, Ala, or Gly
  SITE (83)..(83): Xaa at position 83 is Ala, Gly, or Pro
  SITE (85)..(85): Xaa at position 85 is Phe, Tyr, Met, His, Ile, Leu, Val Ala, or Gly
  SITE (103)..(103): Xaa at position 103 is Leu, Ala, Val, Gly, or Ile
  SITE (127)..(127): Xaa at position 127 is Leu, Ala, Val, Gly, or Ile
  SITE (138)..(138): Xaa at position 138 is Tyr, Phe, Met, His, Ile, Leu, Val Ala, or Gly
  SITE (142)..(142): Xaa at position 142 is Phe, Tyr, Met, His, Ile, Leu, Val Ala, or Gly
  SITE (156)..(156): Xaa at position 156 is Leu, Ala, Val, Gly, or Ile
  SITE (180)..(180): Xaa at position 180 is Val, Ala, Gly, Leu, or Ile
  SITE (181)..(181): Xaa at position 181 is Ala, Gly, or Pro
  SITE (183)..(183): Xaa at position 183 is Cys, Ala, Val, Gly, Ser, or Thr
  SITE (236)..(236): Xaa at position 236 is Val, Ala, Gly, Leu, or Ile
  SITE (238)..(238): Xaa at position 238 is Cys, Ala, Val, Gly, Ser, or Thr
  SITE (240)..(240): Xaa at position 240 is Val, Ala, Gly, Leu, or Ile
  SITE (255)..(255): Xaa at position 255 is Leu, Ala, Val, Gly, or Ile
  SITE (257)..(257): Xaa at position 257 is Val, Ala, Gly, Leu, or Ile
  SITE (263)..(263): Xaa at position 263 is Val, Ala, Gly, Leu, or Ile
  SITE (272)..(272): Xaa at position 272 is Trp, Tyr, Phe, Met, His, Ile, Leu Val, Ala, or Gly
  SITE (314)..(314): Xaa at position 314 is Leu, Ala, Val, Gly, or Ile
  SITE (329)..(329): Xaa at position 329 is Cys, Ala, Val, Gly, Ser, or Thr
  SITE (331)..(331): Xaa at position 331 is Val, Ala, Gly, Leu, or Ile
MARAAALLPSRSPPTPLLWPLLLLLLLETGAQDVRVQVLPEVRGQLGGTVEXPXHLLPPVPGLYISLXTXQRPDAPANHQNVXAXHPKMGPSFPSPKPGSERXSFVSAKQSTGQDTEAELQDATLAXHGLTVEDEGNXTCEXATFPKGSVRGMTWXRVIAKPKNQAEAQKVTFSQDPTTXXLXISKEGRPPARISWLSSLDWEAKETQVSGTLAGTVTVTSRFTLVPSGRADGVTXTXKXEHESFEEPALIPVTXSXRYPPEXSISGYDDNXYLGRTDATLSCDVRSNPEPTGYDWSTTSGTFPTSAVAQGSQXVIHAVDSLFNTTFVXTXTNAVGMGRAEQVIFVRETPNTAGAGATGGIIGGIIAAIIATAVAATGILICRQQRKEQTLQGAEEDEDLEGPPSYKPPTPKAKLEAQEMPSQLFTLGASEHSPLKTPYFDAGASCTEQEMPRYHELPTLEERSGPLHPGATSLGSPIPVPPGPPAVEDVSLDLEDEEGEEEEEYLDKINPIYDALSYSSPSDSYQGKGFVMSRAMYV

SEQ ID NO: 813 - protein, 4967 aa, Homo sapiens
  SITE (14)..(14): Xaa at position 14 is Leu, Ala, Val, Gly, or Ile
  SITE (20)..(20): Xaa at position 20 is Val, Ala, Gly, Leu, or Ile
  SITE (21)..(21): Xaa at position 21 is Val, Ala, Gly, Leu, or Ile
  SITE (22)..(22): Xaa at position 22 is Leu, Ala, Val, Gly, or Ile
  SITE (24)..(24): Xaa at position 24 is Cys, Ala, Val, Gly, Ser, or Thr
  SITE (26)..(26): Xaa at position 26 is Ala, Gly, or Pro
  SITE (35)..(35): Xaa at position 35 is Leu, Ala, Val, Gly, or Ile
  SITE (36)..(36): Xaa at position 36 is Cys, Ala, Val, Gly, Ser, or Thr
  SITE (37)..(37): Xaa at position 37 is Leu, Ala, Val, Gly, or Ile
  SITE (38)..(38): Xaa at position 38 is Ala, Gly, or Pro
  SITE (39)..(39): Xaa at position 39 is Ala, Gly, or Pro
  SITE (64)..(64): Xaa at position 64 is Ile, Ala, Val, Leu, or Gly
  SITE (65)..(65): Xaa at position 65 is Cys, Ala, Val, Gly, Ser, or Thr
  SITE (67)..(67): Xaa at position 67 is Phe, Tyr, Met, His, Ile, Leu, Val Ala, or Gly
  SITE (69)..(69): Xaa at position 69 is Leu, Ala, Val, Gly, or Ile
  SITE (78)..(78): Xaa at position 78 is Leu, Ala, Val, Gly, or Ile
  SITE (113)..(113): Xaa at position 113 is Leu, Ala, Val, Gly, or Ile
  SITE (115)..(115): Xaa at position 115 is Tyr, Phe, Met, His, Ile, Leu, Val Ala, or Gly
  SITE (118)..(118): Xaa at position 118 is Ala, Gly, or Pro
  SITE (119)..(119): Xaa at position 119 is Ile, Ala, Val, Leu, or Gly
  SITE (121)..(121): Xaa at position 121 is Leu, Ala, Val, Gly, or Ile
  SITE (123)..(123): Xaa at position 123 is His, Phe, Tyr, Lys, Arg, Gly, Ser Thr, Ala, Val, Leu, Ile, Asn, Met, or Gln
  SITE (130)..(130): Xaa at position 130 is Leu, Ala, Val, Gly, or Ile
  SITE (131)..(131): Xaa at position 131 is Cys, Ala, Val, Gly, Ser, or Thr
  SITE (144)..(144): Xaa at position 144 is Ala, Gly, or Pro
  SITE (147)..(147): Xaa at position 147 is Val, Ala, Gly, Leu, or Ile
  SITE (149)..(149): Xaa at position 149 is Leu, Ala, Val, Gly, or Ile
  SITE (158)..(158): Xaa at position 158 is Cys, Ala, Val, Gly, Ser, or Thr
  SITE (160)..(160): Xaa at position 160 is Trp, Tyr, Phe, Met, His, Ile, Leu Val, Ala, or Gly
  SITE (162)..(162): Xaa at position 162 is Ile, Ala, Val, Leu, or Gly
  SITE (175)..(175): Xaa at position 175 is Val, Ala, Gly, Leu, or Ile
  SITE (181)..(181): Xaa at position 181 is Leu, Ala, Val, Gly, or Ile
  SITE (183)..(183): Xaa at position 183 is Leu, Ala, Val, Gly, or Ile
  SITE (192)..(192): Xaa at position 192 is Leu, Ala, Val, Gly, or Ile
  SITE (203)..(203): Xaa at position 203 is Val, Ala, Gly, Leu, or Ile
  SITE (205)..(205): Xaa at position 205 is Ala, Gly, or Pro
  SITE (206)..(206): Xaa at position 206 is Ala, Gly, or Pro
  SITE (212)..(212): Xaa at position 212 is Trp, Tyr, Phe, Met, His, Ile, Leu Val, Ala, or Gly
  SITE (214)..(214): Xaa at position 214 is Val, Ala, Gly, Leu, or Ile
  SITE (228)..(228): Xaa at position 228 is Leu, Ala, Val, Gly, or Ile
  SITE (234)..(234): Xaa at position 234 is Leu, Ala, Val, Gly, or Ile
  SITE (236)..(236): Xaa at position 236 is Leu, Ala, Val, Gly, or Ile
  SITE (238)..(238): Xaa at position 238 is His, Phe, Tyr, Lys, Arg, Gly, Ser Thr, Ala, Val, Leu, Ile, Asn, Met, or Gln
  SITE (244)..(244): Xaa at position 244 is Cys, Ala, Val, Gly, Ser, or Thr
  SITE (245)..(245): Xaa at position 245 is Leu, Ala, Val, Gly, or Ile
  SITE (247)..(247): Xaa at position 247 is Val, Ala, Gly, Leu, or Ile
  SITE (260)..(260): Xaa at position 260 is Val, Ala, Gly, Leu, or Ile
  SITE (262)..(262): Xaa at position 262 is Tyr, Phe, Met, His, Ile, Leu, Val Ala, or Gly
  SITE (267)..(267): Xaa at position 267 is Val, Ala, Gly, Leu, or Ile
  SITE (271)..(271): Xaa at position 271 is Ala, Gly, or Pro
  SITE (274)..(274): Xaa at position 274 is Leu, Ala, Val, Gly, or Ile
  SITE (275)..(275): Xaa at position 275 is Trp, Tyr, Phe, Met, His, Ile, Leu Val, Ala, or Gly
  SITE (277)..(277): Xaa at position 277 is Leu, Ala, Val, Gly, or Ile
  SITE (289)..(289): Xaa at position 289 is Ile, Ala, Val, Leu, or Gly
  SITE (295)..(295): Xaa at position 295 is Phe, Tyr, Met, His, Ile, Leu, Val Ala, or Gly
  SITE (297)..(297): Xaa at position 297 is Leu, Ala, Val, Gly, or Ile
  SITE (299)..(299): Xaa at position 299 is His, Phe, Tyr, Lys, Arg, Gly, Ser Thr, Ala, Val, Leu, Ile, Asn, Met, or Gln
  SITE (300)..(300): Xaa at position 300 is Val, Ala, Gly, Leu, or Ile
  SITE (305)..(305): Xaa at position 305 is Tyr, Phe, Met, His, Ile, Leu, Val Ala, or Gly
  SITE (306)..(306): Xaa at position 306 is Leu, Ala, Val, Gly, or Ile
  SITE (315)..(315): Xaa at position 315 is Leu, Ala, Val, Gly, or Ile
  SITE (316)..(316): Xaa at position 316 is Leu, Ala, Val, Gly, or Ile
  SITE (322)..(322): Xaa at position 322 is Ala, Gly, or Pro
  SITE (329)..(329): Xaa at position 329 is Phe, Tyr, Met, His, Ile, Leu, Val Ala, or Gly
  SITE (331)..(331): Xaa at position 331 is Phe, Tyr, Met, His, Ile, Leu, Val Ala, or Gly
  SITE (354)..(354): Xaa at position 354 is Ile, Ala, Val, Leu, or Gly
  SITE (361)..(361): Xaa at position 361 is Cys, Ala, Val, Gly, Ser, or Thr
  SITE (363)..(363): Xaa at position 363 is Ile, Ala, Val, Leu, or Gly
  SITE (372)..(372): Xaa at position 372 is Leu, Ala, Val, Gly, or Ile
  SITE (391)..(391): Xaa at position 391 is Ala, Gly, or Pro
  SITE (403)..(403): Xaa at position 403 is Ile, Ala, Val, Leu, or Gly
  SITE (405)..(405): Xaa at position 405 is Leu, Ala, Val, Gly, or Ile
  SITE (416)..(416): Xaa at position 416 is Ala, Gly, or Pro
  SITE (418)..(418): Xaa at position 418 is Val, Ala, Gly, Leu, or Ile
  SITE (419)..(419): Xaa at position 419 is Ile, Ala, Val, Leu, or Gly
  SITE (426)..(426): Xaa at position 426 is Phe, Tyr, Met, His, Ile, Leu, Val Ala, or Gly
  SITE (429)..(429): Xaa at position 429 is Phe, Tyr, Met, His, Ile, Leu, Val Ala, or Gly
  SITE (447)..(447): Xaa at position 447 is Leu, Ala, Val, Gly, or Ile
  SITE (452)..(452): Xaa at position 452 is Val, Ala, Gly, Leu, or Ile
  SITE (456)..(456): Xaa at position 456 is Leu, Ala, Val, Gly, or Ile
  SITE (459)..(459): Xaa at position 459 is Leu, Ala, Val, Gly, or Ile
  SITE (460)..(460): Xaa at position 460 is Ile, Ala, Val, Leu, or Gly
  SITE (463)..(463): Xaa at position 463 is Phe, Tyr, Met, His, Ile, Leu, Val Ala, or Gly
  SITE (482)..(482): Xaa at position 482 is Leu, Ala, Val, Gly, or Ile
  SITE (488)..(488): Xaa at position 488 is Leu, Ala, Val, Gly, or Ile
  SITE (489)..(489): Xaa at position 489 is Phe, Tyr, Met, His, Ile, Leu, Val Ala, or Gly
  SITE (494)..(494): Xaa at position 494 is Met, Ile, Leu, Val, Ala, or Gly
  SITE (498)..(498): Xaa at position 498 is Val, Ala, Gly, Leu, or Ile
  SITE (501)..(501): Xaa at position 501 is Cys, Ala, Val, Gly, Ser, or Thr
  SITE (502)..(502): Xaa at position 502 is Ile, Ala, Val, Leu, or Gly
  SITE (505)..(505): Xaa at position 505 is Leu, Ala, Val, Gly, or Ile
  SITE (514)..(514): Xaa at position 514 is Phe, Tyr, Met, His, Ile, Leu, Val Ala, or Gly
  SITE (518)..(518): Xaa at position 518 is Ala, Gly, or Pro
  SITE (529)..(529): Xaa at position 529 is Ile, Ala, Val, Leu, or Gly
  SITE (530)..(530): Xaa at position 530 is Leu, Ala, Val, Gly, or Ile
  SITE (533)..(533): Xaa at position 533 is Leu, Ala, Val, Gly, or Ile
  SITE (536)..(536): Xaa at position 536 is Leu, Ala, Val, Gly, or Ile
  SITE (539)..(539): Xaa at position 539 is Ala, Gly, or Pro
  SITE (540)..(540): Xaa at position 540 is Leu, Ala, Val, Gly, or Ile
  SITE (697)..(697): Xaa at position 697 is Trp, Tyr, Phe, Met, His, Ile, Leu Val, Ala, or Gly
  SITE (698)..(698): Xaa at position 698 is Ala, Gly, or Pro
  SITE (718)..(718): Xaa at position 718 is Val, Ala, Gly, Leu, or Ile
  SITE (757)..(757): Xaa at position 757 is Cys, Ala, Val, Gly, Ser, or Thr
  SITE (766)..(766): Xaa at position 766 is Ile, Ala, Val, Leu, or Gly
  SITE (791)..(791): Xaa at position 791 is Val, Ala, Gly, Leu, or Ile
  SITE (792)..(792): Xaa at position 792 is Val, Ala, Gly, Leu, or Ile
  SITE (886)..(886): Xaa at position 886 is Ala, Gly, or Pro
  SITE (921)..(921): Xaa at position 921 is Phe, Tyr, Met, His, Ile, Leu, Val Ala, or Gly
  SITE (996)..(996): Xaa at position 996 is Val, Ala, Gly, Leu, or Ile
  SITE (1000)..(1000): Xaa at position 1000 is Ala, Gly, or Pro
  SITE (1004)..(1004): Xaa at position 1004 is His, Phe, Tyr, Lys, Arg, Gly Ser, Thr, Ala, Val, Leu, Ile, Asn, Met, or Gln
  SITE (1050)..(1050): Xaa at position 1050 is Leu, Ala, Val, Gly, or Ile
  SITE (1054)..(1054): Xaa at position 1054 is Val, Ala, Gly, Leu, or Ile
  SITE (1115)..(1115): Xaa at position 1115 is Val, Ala, Gly, Leu, or Ile
  SITE (1117)..(1117): Xaa at position 1117 is Trp, Tyr, Phe, Met, His, Ile Leu, Val, Ala, or Gly
  SITE (1128)..(1128): Xaa at position 1128 is Leu, Ala, Val, Gly, or Ile
  SITE (1134)..(1134): Xaa at position 1134 is Ala, Gly, or Pro
  SITE (1136)..(1136): Xaa at position 1136 is Ala, Gly, or Pro
  SITE (1137)..(1137): Xaa at position 1137 is Phe, Tyr, Met, His, Ile, Leu Val, Ala, or Gly
  SITE (1162)..(1162): Xaa at position 1162 is Val, Ala, Gly, Leu, or Ile
  SITE (1164)..(1164): Xaa at position 1164 is Cys, Ala, Val, Gly, Ser, or Thr
  SITE (1166)..(1166): Xaa at position 1166 is Val, Ala, Gly, Leu, or Ile
  SITE (1173)..(1173): Xaa at position 1173 is Met, Ile, Leu, Val, Ala, or Gly
  SITE (1175)..(1175): Xaa at position 1175 is Phe, Tyr, Met, His, Ile, Leu Val, Ala, or Gly
  SITE (1195)..(1195): Xaa at position 1195 is Phe, Tyr, Met, His, Ile, Leu Val, Ala, or Gly
  SITE (1204)..(1204): Xaa at position 1204 is Val, Ala, Gly, Leu, or Ile
  SITE (1443)..(1443): Xaa at position 1443 is Val, Ala, Gly, Leu, or Ile
  SITE (1445)..(1445): Xaa at position 1445 is Trp, Tyr, Phe, Met, His, Ile Leu, Val, Ala, or Gly
  SITE (1446)..(1446): Xaa at position 1446 is Ile, Ala, Val, Leu, or Gly
  SITE (1459)..(1459): Xaa at position 1459 is Leu, Ala, Val, Gly, or Ile
  SITE (1465)..(1465): Xaa at position 1465 is Val, Ala, Gly, Leu, or Ile
  SITE (1467)..(1467): Xaa at position 1467 is Val, Ala, Gly, Leu, or Ile
  SITE (1469)..(1469): Xaa at position 1469 is Leu, Ala, Val, Gly, or Ile
  SITE (1507)..(1507): Xaa at position 1507 is Ile, Ala, Val, Leu, or Gly
  SITE (1518)..(1518): Xaa at position 1518 is Leu, Ala, Val, Gly, or Ile
  SITE (1520)..(1520): Xaa at position 1520 is Phe, Tyr, Met, His, Ile, Leu Val, Ala, or Gly
  SITE (1542)..(1542): Xaa at position 1542 is Ala, Gly, or Pro
  SITE (2720)..(2720): Xaa at position 2720 is Phe, Tyr, Met, His, Ile, Leu Val, Ala, or Gly
  SITE (2725)..(2725): Xaa at position 2725 is Ala, Gly, or Pro
  SITE (2727)..(2727): Xaa at position 2727 is His, Phe, Tyr, Lys, Arg, Gly Ser, Thr, Ala, Val, Leu, Ile, Asn, Met, or Gln
  SITE (2729)..(2729): Xaa at position 2729 is His, Phe, Tyr, Lys, Arg, Gly Ser, Thr, Ala, Val, Leu, Ile, Asn, Met, or Gln
  SITE (2779)..(2779): Xaa at position 2779 is Leu, Ala, Val, Gly, or Ile
  SITE (2782)..(2782): Xaa at position 2782 is Met, Ile, Leu, Val, Ala, or Gly
  SITE (2828)..(2828): Xaa at position 2828 is Met, Ile, Leu, Val, Ala, or Gly
  SITE (2840)..(2840): Xaa at position 2840 is Met, Ile, Leu, Val, Ala, or Gly
  SITE (2844)..(2844): Xaa at position 2844 is Met, Ile, Leu, Val, Ala, or Gly
  SITE (2845)..(2845): Xaa at position 2845 is Ala, Gly, or Pro
  SITE (2889)..(2889): Xaa at position 2889 is Ala, Gly, or Pro
  SITE (2892)..(2892): Xaa at position 2892 is Ile, Ala, Val, Leu, or Gly
  SITE (2893)..(2893): Xaa at position 2893 is Leu, Ala, Val, Gly, or Ile
  SITE (2896)..(2896): Xaa at position 2896 is Leu, Ala, Val, Gly, or Ile
MADGGEGEDEIQFXRTDDEXXXQXTXTIHKEQQKXXXXXEGFGNRLCFLESTSNSKNVPPDLSXXTXVXEQSLSVRAXQEMLANTVEKSEGQVDVEKWKFMMKTAQGGGHRTXLXGHXXLXRXSYSGMYXXCLSTSRSSTDKLXFDXGXQEDTTGEAXWXTXHPASKQRSEGEKXRVGDDXIXVSVSSERYXHLSYGNGSLHXDXXFQQTLXSXAPISSGSEAAQGYXIGGDVXRXLXGHMDEXXTXPSGEHGEEQRRTXHXEGGAXSVHXRSXXRXETLRVAWSGSHXRWGQPXRXRXXTTGKXXSLMEDKNLXXMDKEKXDVKSTAXTXRSSKEKLDVGVRKEVDGMGTSEXKYGDSVXYXQHVDTGLWXTYQSVDVKSVRMGSIQRKXIMHHEGHMDDGXSXSRSQHEESRTXRXXRSTVFLXNRXIRGLDALSKKAKASTVDXPIESXSLSXQDXXGYXHPPDEHLEHEDKQNRLRAXKNRQNXXQEEGXINLXLEXXDRXHVYSSAAHXADVXGREAGESWKSXXNSXYEXLAXXIRGNRKNCAQFSGSLDWLISRLERLEASSGILEVLHCVLVESPEALNIIKEGHIKSIISLLDKHGRNHKVLDVLCSLCVCHGVAVRSNQHLICDNLLPGRDLLLQTRLVNHVSSMRPNIFLGVSEGSAQYKKWYYELMVDHTEPFVTAEATHLRVGXXSTEGYSPYPGGGEEWGGNGXGDDLFSYGFDGLHLWSGCIARTVSSPNQHLLRTDDVISXCLDLSAPSXSFRINGQPVQGMFENFNIDGLFFPXXSFSAGIKVRFLLGGRHGEFKFLPPPGYAPCYEAVLPKEKLKVEHSREYKQERTYTRDLLGPTVSLTQAAFTPIPVDTSQIVLPPHLERIREKLXENIHELWVMNKIELGWQYGPVRDDNKRQHPCLVEXSKLPEQERNYNLQMSLETLKTLLALGCHVGISDEHAEDKVKKMKLPKNYQLTSGYKPAPMDLSFIKLTPSQEAMXDKLXENAXNVWARDRIRQGWTYGIQQDVKNRRNPRLVPYTLLDDRTKKSNKDSXREAXRTLLGYGYNLEAPDQDHAARAEVCSGTGERFRIFRAEKTYAVKAGRWYFEFETVTAGDMRXGXSRPGCQPDQEXGSDERXFXXDGFKAQRWHQGNEHYGRSWQAGDVXGXMXDMNEHTXMXTLNGEILLDDSGSELAFKDXDVGDGFIPXCSLGVAQVGRMNFGKDVSTLKYFTICGLQEGYEPFAVNTNRDITMWLSKRLPQFLQVPSNHEHIEVTRIDGTIDSSPCLKVTQKSFGSQNSNTDIMFYRLSMPIECAEVFSKTVAGGLPGAGLFGPKNDLEDYDADSDFEVLMKTAHGHLVPDRVDKDKEATKPEFNNHKDYAQEKPSRLKQRFLLRRTKPDYSTSHSARLTEDVLADDRDDYDFLMQTSTYYYSVRIFPGQEPANVWXGXXTSDFHQYDTGFDXDRVRTXTXTXGDEKGKVHESIKRSNCYMVCAGESMSPGQGRNNNGLEXGCVVDAASGLXTXIANGKELSTYYQVEPSTKLFPXVFAQATSPNVFQFELGRIKNVMPLSAGLFKSEHKNPVPQCPPRLHVQFLSHVLWSRMPNQFLKVDVSRISERQGWLVQCLDPLQFMSLHIPEENRSVDILELTEQEELLKFHYHTLRLYSAVCALGNHRVAHALCSHVDEPQLLYAIENKYMPGLLRAGYYDLLIDIHLSSYATARLMMNNEYIVPMTEETKSITLFPDENKKHGLPGIGLSTSLRPRMQFSSPSFVSISNECYQYSPEFPLDILKSKTIQMLTEAVKEGSLHARDPVGGTTEFLFVPLIKLFYTLLIMGIFHNEDLKHILQLIEPSVFKEAATPEEESDTLEKELSVDDAKLQGAGEEEAKGGKRPKEGLLQMKLPEPVKLQMCLLLQYLCDCQVRHRIEAIVAFSDDFVAKLQDNQRFRYNEVMQALNMSAALTARKTKEFRSPPQEQINMLLNFKDDKSECPCPEEIRDQLLDFHEDLMTHCGIELDEDGSLDGNSDLTIRGRLLSLVEKVTYLKKKQAEKPVESDSKKSSTLQQLISETMVRWAQESVIEDPELVRAMFVLLHRQYDGIGGLVRALPKTYTINGVSVEDTINLLASLGQIRSLLSVRMGKEEEKLMIRGLGDIMNNKVFYQHPNLMRALGMHETVMEVMVNVLGGGESKEITFPKMVANCCRFLCYFCRISRQNQKAMFDHLSYLLENSSVGLASPAMRGSTPLDVAAASVMDNNELALALREPDLEKVVRYLAGCGLQSCQMLVSKGYPDIGWNPVEGERYLDFLRFAVFCNGESVEENANVVVRLLIRRPECFGPALRGEGGNGLLAAMEEAIKIAEDPSRDGPSPNSGSSKTLDTEEEEDDTIHMGNAIMTFYSALIDLLGRCAPEMHLIHAGKGEAIRIRSILRSLIPLGDLVGVISIAFQMPTIAKDGNVVEPDMSAGFCPDHKAAMVLFLDRVYGIEVQDFLLHLLEVGFLPDLRAAASLDTAALSATDMALALNRYLCTAVLPLLTRCAPLFAGTEHHASLIDSLLHTVYRLSKGCSLTKAQRDSIEVCLLSICGQLRPSMMQHLLRRLVFDVPLLNEHAKMPLKLLTNHYERCWKYYCLPGGWGNFGAASEEELHLSRKLFWGIFDALSQKKYEQELFKLALPCLSAVAGALPPDYMESNYVSMMEKQSSMDSEGNFNPQPVDTSNITIPEKLEYXINKYXEXSXDKWSMDKLANGWIYGEIYSDSSKVQPLMKPYKLLSEKEKEIYRWPIKESXKTXLAWGWRIERTREGDSMALYNRTRRISQTSQVSVDAAHGYSPRAIDXSNVTLSRDLHAXAEMXXENYHNIWAKKKKMELESKGGGNHPLLVPYDTLTAKEKAKDREKXQDXXKFXQINGYAVSRGFKDLELDTPSIEKRFAYSFLQQLIRYVDEAHQYILEFDGGSRGKGEHFPYEQEIKFFAKVVLPLIDQYFKNHRLYFLSAASRPLCSGGHASNKEKEMVTSLFCKLGVLVRHRISLFGNDATSIVNCLHILGQTLDARTVMKTGLESVKSALRAFLDNAAEDLEKTMENLKQGQFTHTRNQPKGVTQIINYTTVALLPMLSSLFEHIGQHQFGEDLILEDVQVSCYRILTSLYALGTSKSIYVERQRSALGECLAAFAGAFPVAFLETHLDKHNIYSIYNTKSSRERAALSLPTNVEDVCPNIPSLEKLMEEIVELAESGIRYTQMPHVMEVILPMLCSYMSRWWEHGPENNPERAEMCCTALNSEHMNTLLGNILKIIYNNLGIDEGAWMKRLAVFSQPIINKVKPQLLKTHFLPLMEKLKKKAATVVSEEDHLKAEARGDMSEAELLILDEFTTLARDLYAFYPLLIRFVDYNRAKWLKEPNPEAEELFRMVAEVFIYWSKSHNFKREEQNFVVQNEINNMSFLITDTKSKMSKAAVSDQERKKMKRKGDRYSMQTSLIVAALKRLLPIGLNICAPGDQELIALAKNRFSLKDTEDEVRDIIRSNIHLQGKLEDPAIRWQMALYKDLPNRTDDTSDPEKTVERVLDIANVLFHLEQKSKRVGRRHYCLVEHPQRSKKAVWHKLLSKQRKRAVVACFRMAPLYNLPRHRAVNLFLQGYEKSWIETEEHYFEDKLIEDLAKPGAEPPEEDEGTKRVDPLHQLILLFSRTALTEKCKLEEDFLYMAYADIMAKSCHDEEDDDGEEEVKSFEEKEMEKQKLLYQQARLHDRGAAEMVLQTISASKGETGPMVAATLKLGIAILNGGNSTVQQKMLDYLKEKKDVGFFQSLAGLMQSCSVLDLNAFERQNKAEGLGMVTEEGSGEKVLQDDEFTCDLFRFLQLLCEGHNSDFQNYLRTQTGNNTTVNIIISTVDYLLRVQESISDFYWYYSGKDVIDEQGQRNFSKAIQVAKQVFNTLTEYIQGPCTGNQQSLAHSRLWDAVVGFLHVFAHMQMKLSQDSSQIELLKELMDLQKDMVVMLLSMLEGNVVNGTIGKQMVDMLVESSNNVEMILKFFDMFLKLKDLTSSDTFKEYDPDGKGVISKRDFHKAMESHKHYTQSETEFLLSCAETDENETLDYEEFVKRFHEPAKDIGFNVAVLLTNLSEHMPNDTRLQTFLELAESVLNYFQPFLGRIEIMGSAKRIERVYFEISESSRTQWEKPQVKESKRQFIFDVVNEGGEKEKMELFVNFCEDTIFEMQLAAQISESDLNERSANKEESEKERPEEQGPRMAFFSILTVRSALFALRYNILTLMRMLSLKSLKKQMKKVKKMTVKDMVTAFFSSYWSIFMTLLHFVASVFRGFFRIICSLLLGGSLVEGAKKIKVAELLANMPDPTQDEVRGDGEEGERKPLEAALPSEDLTDLKELTEESDLLSDIFGLDLKREGGQYKLIPHNPNAGLSDLMSNPVPMPEVQEKFQEQKAKEEEKEEKEETKSEPEKAEGEDGEKEEKAKEDKGKQKLRQLHTHRYGEPEVPESAFWKKIIAYQQKLLNYFARNFYNMRMLALFVAFAINFILLFYKVSTSSVVEGKELPTRSSSENAKVTSLDSSSHRIIAVHYVLEESSGYMEPTLRILAILHTVISFFCIIGYYCLKVPLVIFKREKEVARKLEFDGLYITEQPSEDDIKGQWDRLVINTQSFPNNYWDKFVKRKVMDKYGEFYGRDRISELLGMDKAALDFSDAREKKKPKKDSSLSAVLNSIDVKYQMWKLGVVFTDNSFLYLAWYMTMSVLGHYNNFFFAAHLLDIAMGFKTLRTILSSVTHNGKQLVLTVGLLAVVVYLYTVVAFNFFRKFYNKSEDGDTPDMKCDDMLTCYMFHMYVGVRAGGGIGDEIEDPAGDEYEIYRIIFDITFFFFVIVILLAIIQGLIIDAFGELRDQQEQVKEDMETKCFICGIGNDYFDTVPHGFETHTLQEHNLANYLFFLMYLINKDETEHTGQESYVWKMYQERCWEFFPAGDCFRKQYEDQLN

SEQ ID NO: 814 - protein, 480 aa, Homo sapiens
  SITE (53)..(53): Xaa at position 53 is Cys, Ala, Val, Gly, Ser, or Thr
  SITE (76)..(76): Xaa at position 76 is Cys, Ala, Val, Gly, Ser, or Thr
  SITE (132)..(132): Xaa at position 132 is Leu, Ala, Val, Gly, or Ile
  SITE (150)..(150): Xaa at position 150 is Leu, Ala, Val, Gly, or Ile
  SITE (175)..(175): Xaa at position 175 is Val, Ala, Gly, Leu, or Ile
  SITE (179)..(179): Xaa at position 179 is Ile, Ala, Val, Leu, or Gly
  SITE (182)..(182): Xaa at position 182 is Ala, Gly, or Pro
  SITE (183)..(183): Xaa at position 183 is Val, Ala, Gly, Leu, or Ile
  SITE (184)..(184): Xaa at position 184 is Val, Ala, Gly, Leu, or Ile
  SITE (185)..(185): Xaa at position 185 is His, Phe, Tyr, Lys, Arg, Gly, Ser Thr, Ala, Val, Leu, Ile, Asn, Met, or Gln
  SITE (186)..(186): Xaa at position 186 is Ile, Ala, Val, Leu, or Gly
  SITE (188)..(188): Xaa at position 188 is Leu, Ala, Val, Gly, or Ile
  SITE (207)..(207): Xaa at position 207 is Phe, Tyr, Met, His, Ile, Leu, Val Ala, or Gly
  SITE (208)..(208): Xaa at position 208 is Ile, Ala, Val, Leu, or Gly
  SITE (215)..(215): Xaa at position 215 is Ile, Ala, Val, Leu, or Gly
  SITE (216)..(216): Xaa at position 216 is Val, Ala, Gly, Leu, or Ile
  SITE (219)..(219): Xaa at position 219 is Ala, Gly, or Pro
  SITE (221)..(221): Xaa at position 221 is Val, Ala, Gly, Leu, or Ile
  SITE (222)..(222): Xaa at position 222 is Val, Ala, Gly, Leu, or Ile
  SITE (228)..(228): Xaa at position 228 is Val, Ala, Gly, Leu, or Ile
  SITE (230)..(230): Xaa at position 230 is Val, Ala, Gly, Leu, or Ile
  SITE (240)..(240): Xaa at position 240 is Ala, Gly, or Pro
  SITE (249)..(249): Xaa at position 249 is Ala, Gly, or Pro
  SITE (251)..(251): Xaa at position 251 is Ile, Ala, Val, Leu, or Gly
  SITE (252)..(252): Xaa at position 252 is Ala, Gly, or Pro
  SITE (254)..(254): Xaa at position 254 is Ile, Ala, Val, Leu, or Gly
  SITE (256)..(256): Xaa at position 256 is Ile, Ala, Val, Leu, or Gly
  SITE (279)..(279): Xaa at position 279 is Val, Ala, Gly, Leu, or Ile
  SITE (280)..(280): Xaa at position 280 is Val, Ala, Gly, Leu, or Ile
  SITE (281)..(281): Xaa at position 281 is Ala, Gly, or Pro
  SITE (282)..(282): Xaa at position 282 is Ile, Ala, Val, Leu, or Gly
  SITE (297)..(297): Xaa at position 297 is Val, Ala, Gly, Leu, or Ile
  SITE (317)..(317): Xaa at position 317 is Ile, Ala, Val, Leu, or Gly
  SITE (321)..(321): Xaa at position 321 is Ala, Gly, or Pro
  SITE (323)..(323): Xaa at position 323 is Ile, Ala, Val, Leu, or Gly
  SITE (332)..(332): Xaa at position 332 is Leu, Ala, Val, Gly, or Ile
  SITE (333)..(333): Xaa at position 333 is Val, Ala, Gly, Leu, or Ile
  SITE (339)..(339): Xaa at position 339 is Val, Ala, Gly, Leu, or Ile
  SITE (340)..(340): Xaa at position 340 is Ile, Ala, Val, Leu, or Gly
  SITE (342)..(342): Xaa at position 342 is Ile, Ala, Val, Leu, or Gly
  SITE (353)..(353): Xaa at position 353 is Phe, Tyr, Met, His, Ile, Leu, Val Ala, or Gly
  SITE (354)..(354): Xaa at position 354 is Ala, Gly, or Pro
  SITE (355)..(355): Xaa at position 355 is Ile, Ala, Val, Leu, or Gly
  SITE (360)..(360): Xaa at position 360 is Ile, Ala, Val, Leu, or Gly
  SITE (363)..(363): Xaa at position 363 is Phe, Tyr, Met, His, Ile, Leu, Val Ala, or Gly
  SITE (383)..(383): Xaa at position 383 is Ile, Ala, Val, Leu, or Gly
  SITE (395)..(395): Xaa at position 395 is Ala, Gly, or Pro
  SITE (398)..(398): Xaa at position 398 is Leu, Ala, Val, Gly, or Ile
  SITE (412)..(412): Xaa at position 412 is Ala, Gly, or Pro
  SITE (414)..(414): Xaa at position 414 is Ile, Ala, Val, Leu, or Gly
  SITE (423)..(423): Xaa at position 423 is Ala, Gly, or Pro
  SITE (428)..(428): Xaa at position 428 is Leu, Ala, Val, Gly, or Ile
  SITE (433)..(433): Xaa at position 433 is Val, Ala, Gly, Leu, or Ile
  SITE (434)..(434): Xaa at position 434 is Ile, Ala, Val, Leu, or Gly
  SITE (437)..(437): Xaa at position 437 is Ile, Ala, Val, Leu, or Gly
  SITE (448)..(448): Xaa at position 448 is Val, Ala, Gly, Leu, or Ile
  SITE (452)..(452): Xaa at position 452 is Ile, Ala, Val, Leu, or Gly
  SITE (458)..(458): Xaa at position 458 is Leu, Ala, Val, Gly, or Ile
  SITE (460)..(460): Xaa at position 460 is Met, Ile, Leu, Val, Ala, or Gly
  SITE (462)..(462): Xaa at position 462 is Val, Ala, Gly, Leu, or Ile
  SITE (471)..(471): Xaa at position 471 is Ile, Ala, Val, Leu, or Gly
  SITE (473)..(473): Xaa at position 473 is Val, Ala, Gly, Leu, or Ile
MQIPRAALLPLLLLLLAAPASAQLSRAGRSAPLAAGCPDRCEPARCPPQPEHXEGGRARDACGCCEVCGAPEGAAXGLQEGPCGEGLQCVVPFGVPASATVRRRAQAGLCVCASSEPVCGSDANTYANLCQXRAASRRSERLHRPPVIVXQRGACGQGQEDPNSLRHKYNFIADXVEKXAPXXXXXEXFRKLPFSKREVPVASGSGXXVSEDGLXXTNXHXXTNKHRXKXELKNGATYEXKIKDVDEKXDXXLXKXDHQGKLPVLLLGRSSELRPGEFXXXXGSPFSLQNTVTTGIXSTTQRGGKELGLRNSDMDYXQTDXIXNYGNSGGPXXNLDGEXXGXNTLKVTAGISXXXPSDKXKKXLTESHDRQAKGKAITKKKYXGIRMMSLTSSKXKEXKDRHRDFPDVISGXYXIEVIPDTPXEAGGXKENDXXISXNGQSVVSANDXSDVXKRESTXNXVXRRGNEDIMXTXIPEEIDP

SEQ ID NO: 815 - protein, 325 aa, Homo sapiens
  SITE (63)..(63): Xaa at position 63 is Ala, Gly, or Pro
MVCGSPGGMLLLRAGLLALAALCLLRVPGARAAACEPVRIPLCKSLPWNMTKMPNHLHHSTQXNAILAIEQFEGLLGTHCSPDLLFFLCAMYAPICTIDFQHEPIKPCKSVCERARQGCEPILIKYRHSWPENLACEELPVYDRGVCISPEAIVTADGADFPMDSSNGNCRGASSERCKCKPIRATQKTYFRNNYNYVIRAKVKEIKTKCHDVTAVVEVKEILKSSLVNIPRDTVNLYTSSGCLCPPLNVNEEYIIMGYEDEERSRLLLVEGSIAEKWKDRLGKKVKRWDMKLRHLGLSKSDSSNSDSTQSQKSGRNSNPRQARN

SEQ ID NO: 816 - protein, 1687 aa, Homo sapiens
  SITE (701)..(701): Xaa at position 701 is Cys, Ala, Val, Gly, Ser, or Thr
  SITE (792)..(792): Xaa at position 792 is Cys, Ala, Val, Gly, Ser, or Thr
  SITE (805)..(805): Xaa at position 805 is Cys, Ala, Val, Gly, Ser, or Thr
  SITE (1514)..(1514): Xaa at position 1514 is Cys, Ala, Val, Gly, Ser, or Thr
MTSSSPAGLEGSDLSSINTMMSAVMSVGKVTENGGSPQGIKSPSKPPGPNRIGRRNQETKEEKSSYNCPLCEKICTTQHQLTMHIRQHNTDTGGADHSCSICGKSLSSASSLDRHMLVHSGERPYKCTVCGQSFTTNGNMHRHMKIHEKDPNSATATAPPSPLKRRRLSSKRKLSHDAESEREDPAPAKKMVEDGQSGDLEKKADEVFHCPVCFKEFVCKYGLETHMETHSDNPLRCDICCVTFRTHRGLLRHNALVHKQLPRDAMGRPFIQNNPSIPAGFHDLGFTDFSCRKFPRISQAWCETNLRRCISEQHRFVCDTCDKAFPMLCSLALHKQTHVAADQGQEKPQATPLPGDALDQKGFLALLGLQHTKDVRPAPAEEPLPDDNQAIQLQTLKCQLPQDPGCTNLLSLSPFEAASLGGSLTVLPATKDSIKHLSLQPFQKGFIIQPDSSIVVKPISGESAIELADIQQILKMAASAPPQISLPPFSKAPAAPLQAIFKHMPPLKPKPLVTPRTVVATSTPPPLINAQQASPGCISPSLPPPPLKLLKGSVEAASNAHLLQSKSGTQPHAATRLSLQQPRAELPGQPEMKTQLEQDSIIEALLPLSMEAKIKQEITEGELKAFMTAPGGKKTPAMRKVLYPCRFCNQVFAFSGVLRAHVRSHLGISPYQCNICDYIAADKAALIRHLRTHSGERPYIXKICHYPFTVKANCERHLRKKHLKATRKDIEKNIEYVSSSAAELVDAFCAPDTVCRLCGEDLKHYRALRIHMRTHCGRGLGGGHKGRKPFEXKECSAAFAAKRNXIHHILKQHLHVPEQDIESYVLAADGLGPAEAPAAEASGRGEDSGCAALGDCKPLTAFLEPQNGFLHRGPTQPPPPHVSIKLEPASSFAVDFNEPLDFSQKGLALVQVKQENISFLSPSSLVPYDCSMEPIDLSIPKNFRKGDKDLATPSEAKKPEEEAGSSEQPSPCPAPGPSLPVTLGPSGILESPMAPAPAATPEPPAQPLQGPVQLAVPIYSSALVSSPPLVGSSALLSGTALLRPLRPKPPLLLPKPPVTEELPPLASIAQIISSVSSAPTLLKTKVADPGPASTGSNTTASDSLGGSVPKAATTATPAATTSPKESSEPPAPASSPEAASPTEQGPAGTSKKRGRKRGMRSRPRANSGGVDLDSSGEFASIEKMLATTDTNKFSPFLQTAEDNTQDEVAGAPADHHGPSDEEQGSPPEDKLLRAKRNSYTNCLQKITCPHCPRVFPWASSLQRHMLTHTDSQSDAETAAAAGEVLDLTSRDREQPSEGATELRQVAGDAPVEQATAETASPVHREEHGRGESHEPEEEHGTEESTGDADGAEEDASSNQSLDLDFATKLMDFKLAEGDGEAGAGGAASQEQKLACDTCGKSFKFLGTLSRHRKAHGRQEPKDEKGDGASTAEEGPQPAPEQEEKPPETPAEVVESAPGAGEAPAEKLAEETEGPSDGESAAEKRSSEKSDDDKKPKTDSPKSVASKADKRKKVXSVCNKRFWSLQDLTRHMRSHTGERPYKCQTCERTFTLKHSLVRHQRIHQKARHAKHHGKDSDKEERGEEDSENESTHSGNNAVSENEAELAPNASNHMAVTRSRKEGLASATKDCSHREEKVTAGWPSEPGQGDLNPESPAALGQDLLEPRSKRPAHPILATADGASQLVGME

SEQ ID NO: 817 - protein, 817 aa, Homo sapiens
  SITE (132)..(132): Xaa at position 132 is Ile, Ala, Val, Leu, or Gly
  SITE (134)..(134): Xaa at position 134 is Leu, Ala, Val, Gly, or Ile
  SITE (141)..(141): Xaa at position 141 is Leu, Ala, Val, Gly, or Ile
  SITE (146)..(146): Xaa at position 146 is Ala, Gly, or Pro
  SITE (154)..(154): Xaa at position 154 is Val, Ala, Gly, Leu, or Ile
  SITE (160)..(160): Xaa at position 160 is Ile, Ala, Val, Leu, or Gly
  SITE (162)..(162): Xaa at position 162 is Ile, Ala, Val, Leu, or Gly
  SITE (170)..(170): Xaa at position 170 is Ala, Gly, or Pro
  SITE (171)..(171): Xaa at position 171 is Ala, Gly, or Pro
  SITE (179)..(179): Xaa at position 179 is Val, Ala, Gly, Leu, or Ile
  SITE (183)..(183): Xaa at position 183 is Val, Ala, Gly, Leu, or Ile
  SITE (184)..(184): Xaa at position 184 is Leu, Ala, Val, Gly, or Ile
  SITE (186)..(186): Xaa at position 186 is Val, Ala, Gly, Leu, or Ile
  SITE (191)..(191): Xaa at position 191 is Val, Ala, Gly, Leu, or Ile
  SITE (199)..(199): Xaa at position 199 is Ala, Gly, or Pro
  SITE (202)..(202): Xaa at position 202 is Ala, Gly, or Pro
  SITE (203)..(203): Xaa at position 203 is Leu, Ala, Val, Gly, or Ile
  SITE (206)..(206): Xaa at position 206 is Ala, Gly, or Pro
  SITE (210)..(210): Xaa at position 210 is Val, Ala, Gly, Leu, or Ile
  SITE (212)..(212): Xaa at position 212 is Leu, Ala, Val, Gly, or Ile
  SITE (214)..(214): Xaa at position 214 is Val, Ala, Gly, Leu, or Ile
  SITE (227)..(227): Xaa at position 227 is Val, Ala, Gly, Leu, or Ile
  SITE (229)..(229): Xaa at position 229 is Leu, Ala, Val, Gly, or Ile
  SITE (236)..(236): Xaa at position 236 is Leu, Ala, Val, Gly, or Ile
  SITE (240)..(240): Xaa at position 240 is Ile, Ala, Val, Leu, or Gly
  SITE (255)..(255): Xaa at position 255 is Ile, Ala, Val, Leu, or Gly
  SITE (257)..(257): Xaa at position 257 is Ile, Ala, Val, Leu, or Gly
  SITE (265)..(265): Xaa at position 265 is Ala, Gly, or Pro
  SITE (266)..(266): Xaa at position 266 is Ala, Gly, or Pro
  SITE (278)..(278): Xaa at position 278 is Leu, Ala, Val, Gly, or Ile
  SITE (281)..(281): Xaa at position 281 is Val, Ala, Gly, Leu, or Ile
  SITE (286)..(286): Xaa at position 286 is Leu, Ala, Val, Gly, or Ile
  SITE (294)..(294): Xaa at position 294 is Ala, Gly, or Pro
  SITE (298)..(298): Xaa at position 298 is Leu, Ala, Val, Gly, or Ile
  SITE (305)..(305): Xaa at position 305 is Val, Ala, Gly, Leu, or Ile
  SITE (307)..(307): Xaa at position 307 is Leu, Ala, Val, Gly, or Ile
  SITE (309)..(309): Xaa at position 309 is Val, Ala, Gly, Leu, or Ile
  SITE (310)..(310): Xaa at position 310 is Ala, Gly, or Pro
  SITE (387)..(387): Xaa at position 387 is Ile, Ala, Val, Leu, or Gly
  SITE (389)..(389): Xaa at position 389 is Leu, Ala, Val, Gly, or Ile
  SITE (409)..(409): Xaa at position 409 is Ile, Ala, Val, Leu, or Gly
  SITE (410)..(410): Xaa at position 410 is Phe, Tyr, Met, His, Ile, Leu, Val Ala, or Gly
  SITE (411)..(411): Xaa at position 411 is Val, Ala, Gly, Leu, or Ile
  SITE (420)..(420): Xaa at position 420 is Ala, Gly, or Pro
  SITE (426)..(426): Xaa at position 426 is Leu, Ala, Val, Gly, or Ile
  SITE (432)..(432): Xaa at position 432 is Ile, Ala, Val, Leu, or Gly
  SITE (435)..(435): Xaa at position 435 is Val, Ala, Gly, Leu, or Ile
  SITE (448)..(448): Xaa at position 448 is Ala, Gly, or Pro
  SITE (451)..(451): Xaa at position 451 is Ala, Gly, or Pro
  SITE (459)..(459): Xaa at position 459 is Val, Ala, Gly, Leu, or Ile
  SITE (461)..(461): Xaa at position 461 is Ile, Ala, Val, Leu, or Gly
  SITE (463)..(463): Xaa at position 463 is Ala, Gly, or Pro
MHKHQHCCKCPECYEVTRLAALRRLEPPGYGDWQVPDPYGPGGGNGASAGYGGYSSQTLPSQAGATPTPRTKAKLIPTGRDVGPVPPKPVPGKSTPKLNGSGPSWWPECTCTNRDWYEQVNGSDGMFKYEEXVXERGNSGXGFSIXGGIDNPHXPDDPGXFXTKIIPGGXXAMDGRLGXNDCXXRXNEVDXSEVVHSRXVEXXKEXGPVXRXVXRRRQPPPETIMEXNXLKGPKGXGFSXAGGIGNQHIPGDNSXYXTKIIEGGXXQKDGRLQIGDRXLAXNNTNXQDVRHEEXVASXKNTSDMXYXKXXKPGSLHLNDMYAPPDYASTFTALADNHISHNSSLGYLGAVESKVSYPAPPQVPPTRYSPIPRHMLAEEDFTREPRKXIXHKGSTGLGFNIVGGEDGEGXXXSFILAGGPXDLSGEXRRGDRXLSXNGVNLRNATHEQXAAXLKRAGQSXTXVXQYRPEEYSRFESKIHDLREQMMNSSMSSGSGSLRTSEKRSLYVRALFDYDRTRDSCLPSQGLSFSYGDILHVINASDDEWWQARLVTPHGESEQIGVIPSKKRVEKKERARLKTVKFHARTGMIESNRDFPGLSDDYYGAKNLKGQEDAILSYEPVTRQEIHYARPVIILGPMKDRVNDDLISEFPHKFGSCVPHTTRPRRDNEVDGQDYHFVVSREQMEKDIQDNKFIEAGQFNDNLYGTSIQSVRAVAERGKHCILDVSGNAIKRLQQAQLYPIAIFIKPKSIEALMEMNRRQTYEQANKIYDKAMKLEQEFGEYFTAIVQGDSLEEIYNKIKQIIEDQSGHYIWVPSPEKL

SEQ ID NO: 818 - protein, 1020 aa, Homo sapiens
  SITE (13)..(13): Xaa at position 13 is Ala, Gly, or Pro
  SITE (14)..(14): Xaa at position 14 is Val, Ala, Gly, Leu, or Ile
  SITE (46)..(46): Xaa at position 46 is His, Phe, Tyr, Lys, Arg, Gly, Ser Thr, Ala, Val, Leu, Ile, Asn, Met, or Gln
  SITE (48)..(48): Xaa at position 48 is Ala, Gly, or Pro
  SITE (49)..(49): Xaa at position 49 is Val, Ala, Gly, Leu, or Ile
  SITE (50)..(50): Xaa at position 50 is Val, Ala, Gly, Leu, or Ile
  SITE (56)..(56): Xaa at position 56 is Leu, Ala, Val, Gly, or Ile
  SITE (58)..(58): Xaa at position 58 is Met, Ile, Leu, Val, Ala, or Gly
  SITE (59)..(59): Xaa at position 59 is Phe, Tyr, Met, His, Ile, Leu, Val Ala, or Gly
  SITE (67)..(67): Xaa at position 67 is Leu, Ala, Val, Gly, or Ile
  SITE (81)..(81): Xaa at position 81 is Val, Ala, Gly, Leu, or Ile
  SITE (89)..(89): Xaa at position 89 is Val, Ala, Gly, Leu, or Ile
  SITE (92)..(92): Xaa at position 92 is Ala, Gly, or Pro
  SITE (98)..(98): Xaa at position 98 is His, Phe, Tyr, Lys, Arg, Gly, Ser Thr, Ala, Val, Leu, Ile, Asn, Met, or Gln
  SITE (100)..(100): Xaa at position 100 is Leu, Ala, Val, Gly, or Ile
  SITE (101)..(101): Xaa at position 101 is Val, Ala, Gly, Leu, or Ile
  SITE (108)..(108): Xaa at position 108 is Val, Ala, Gly, Leu, or Ile
  SITE (110)..(110): Xaa at position 110 is Ala, Gly, or Pro
  SITE (119)..(119): Xaa at position 119 is Leu, Ala, Val, Gly, or Ile
  SITE (133)..(133): Xaa at position 133 is Ile, Ala, Val, Leu, or Gly
  SITE (153)..(153): Xaa at position 153 is Ala, Gly, or Pro
  SITE (154)..(154): Xaa at position 154 is Ala, Gly, or Pro
  SITE (155)..(155): Xaa at position 155 is Leu, Ala, Val, Gly, or Ile
  SITE (161)..(161): Xaa at position 161 is Leu, Ala, Val, Gly, or Ile
  SITE (163)..(163): Xaa at position 163 is Met, Ile, Leu, Val, Ala, or Gly
  SITE (164)..(164): Xaa at position 164 is Trp, Tyr, Phe, Met, His, Ile, Leu Val, Ala, or Gly
  SITE (172)..(172): Xaa at position 172 is Ile, Ala, Val, Leu, or Gly
  SITE (201)..(201): Xaa at position 201 is His, Phe, Tyr, Lys, Arg, Gly, Ser Thr, Ala, Val, Leu, Ile, Asn, Met, or Gln
  SITE (203)..(203): Xaa at position 203 is Ala, Gly, or Pro
  SITE (204)..(204): Xaa at position 204 is Phe, Tyr, Met, His, Ile, Leu, Val Ala, or Gly
  SITE (205)..(205): Xaa at position 205 is Val, Ala, Gly, Leu, or Ile
  SITE (211)..(211): Xaa at position 211 is Leu, Ala, Val, Gly, or Ile
  SITE (213)..(213): Xaa at position 213 is Val, Ala, Gly, Leu, or Ile
  SITE (214)..(214): Xaa at position 214 is Phe, Tyr, Met, His, Ile, Leu, Val Ala, or Gly
  SITE (222)..(222): Xaa at position 222 is Leu, Ala, Val, Gly, or Ile
  SITE (228)..(228): Xaa at position 228 is Leu, Ala, Val, Gly, or Ile
  SITE (254)..(254): Xaa at position 254 is His, Phe, Tyr, Lys, Arg, Gly, Ser Thr, Ala, Val, Leu, Ile, Asn, Met, or Gln
  SITE (256)..(256): Xaa at position 256 is Val, Ala, Gly, Leu, or Ile
  SITE (257)..(257): Xaa at position 257 is Val, Ala, Gly, Leu, or Ile
  SITE (263)..(263): Xaa at position 263 is Val, Ala, Gly, Leu, or Ile
  SITE (266)..(266): Xaa at position 266 is Phe, Tyr, Met, His, Ile, Leu, Val Ala, or Gly
  SITE (274)..(274): Xaa at position 274 is Leu, Ala, Val, Gly, or Ile
  SITE (280)..(280): Xaa at position 280 is Leu, Ala, Val, Gly, or Ile
  SITE (289)..(289): Xaa at position 289 is Ile, Ala, Val, Leu, or Gly
  SITE (306)..(306): Xaa at position 306 is His, Phe, Tyr, Lys, Arg, Gly, Ser Thr, Ala, Val, Leu, Ile, Asn, Met, or Gln
  SITE (308)..(308): Xaa at position 308 is Ala, Gly, or Pro
  SITE (309)..(309): Xaa at position 309 is Leu, Ala, Val, Gly, or Ile
  SITE (315)..(315): Xaa at position 315 is Leu, Ala, Val, Gly, or Ile
  SITE (316)..(316): Xaa at position 316 is Met, Ile, Leu, Val, Ala, or Gly
  SITE (319)..(319): Xaa at position 319 is Phe, Tyr, Met, His, Ile, Leu, Val Ala, or Gly
  SITE (343)..(343): Xaa at position 343 is Cys, Ala, Val, Gly, Ser, or Thr
  SITE (360)..(360): Xaa at position 360 is His, Phe, Tyr, Lys, Arg, Gly, Ser Thr, Ala, Val, Leu, Ile, Asn, Met, or Gln
  SITE (361)..(361): Xaa at position 361 is Met, Ile, Leu, Val, Ala, or Gly
  SITE (362)..(362): Xaa at position 362 is Val, Ala, Gly, Leu, or Ile
  SITE (363)..(363): Xaa at position 363 is Val, Ala, Gly, Leu, or Ile
  SITE (365)..(365): Xaa at position 365 is Ala, Gly, or Pro
MREPEELMPDSGXXFTFGKSKFAENNPGKFWFKNDVPVHLSCGDEXSXXXTGNNKXYXXGSNNWGQXGLGSKSAISKPTCXKALKPEKXKLXACGRNXTXXSTEGGNXYXTGGNNEGQXGLGDTEERNTFHVXSFFTSEHKIKQLSAGSNTSXXXTEDGRXFXXGDNSEGQXGLKNVSNVCVPQQVTIGKPVSWISCGYYXSXXXTTDGEXYXXGEPENGKXGLPNQXLGNHRTPQLVSEIPEKVIQVACGGEXTXXLTENAXYTXGLGQFGQXGLGTFXFETSEPKVXENIRDQTISYISCGENXTXXITDIGXXYTXGDGRHGKLGLGLENFTNHFIPTLXSNFLRFIVKLVACGGCXXXXFXAPHRGVAKEIEFDEINDTCLSVATFLPYSSLTSGNVLQRTLSARMRRRERERSPDSFSMRRTLPPIEGTLGLSACFLPNSVFPRCSERNLQESVLSEQDLMQPEEPDYLLDEMTKEAEIDNSSTVESLGETTDILNMTHIMSLNSNEKSLKLSPVQKQKKQQTIGELTQDTALTENDDSDEYEEMSEMKEGKACKQHVSQGIFMTQPATTIEAFSDEEVGNDTGQVGPQADTDGEGLQKEVYRHENNNGVDQLDAKEIEKESDGGHSQKESEAEEIDSEKETKLAEIAGMKDLREREKSTKKMSPFFGNLPDRGMNTESEENKDFVKKRESCKQDVIFDSERESVEKPDSYMEGASESQQGIADGFQQPEAIEFSSGEKEDDEVETDQNIRYGRKLIEQGNEKETKPIISKSMAKYDFKCDRLSEIPEEKEGAEDSKGNGIEEQEVEANEENVKVHGGRKEKTEILSDDLTDKAEDHEFSKTEELKLEDVDEEINAENVESKKKTVGDDESVPTGYHSKTEGAERTNDDSSAETIEKKEKANLEERAICEYNENPKGYMLDDADSSSLEILENSETTPSKDMKKTKKIFLFKRVPSINQKIVKNNNEPLPEIKSIGDQIILKSDNKDADQNHMSQNHQNIPPTNTERRSKSCTIL

SEQ ID NO: 819 - protein, 391 aa, Homo sapiens
  SITE (90)..(90): Xaa at position 90 is Leu, Ala, Val, Gly, or Ile
  SITE (251)..(251): Xaa at position 251 is Val, Ala, Gly, Leu, or Ile
  SITE (253)..(253): Xaa at position 253 is Leu, Ala, Val, Gly, or Ile
  SITE (262)..(262): Xaa at position 262 is Val, Ala, Gly, Leu, or Ile
  SITE (271)..(271): Xaa at position 271 is Leu, Ala, Val, Gly, or Ile
  SITE (293)..(293): Xaa at position 293 is Leu, Ala, Val, Gly, or Ile
  SITE (295)..(295): Xaa at position 295 is Val, Ala, Gly, Leu, or Ile
  SITE (301)..(301): Xaa at position 301 is Tyr, Phe, Met, His, Ile, Leu, Val Ala, or Gly
  SITE (303)..(303): Xaa at position 303 is Ile, Ala, Val, Leu, or Gly
  SITE (307)..(307): Xaa at position 307 is Val, Ala, Gly, Leu, or Ile
  SITE (309)..(309): Xaa at position 309 is Val, Ala, Gly, Leu, or Ile
  SITE (311)..(311): Xaa at position 311 is Tyr, Phe, Met, His, Ile, Leu, Val Ala, or Gly
  SITE (312)..(312): Xaa at position 312 is Ile, Ala, Val, Leu, or Gly
  SITE (314)..(314): Xaa at position 314 is Phe, Tyr, Met, His, Ile, Leu, Val Ala, or Gly
  SITE (318)..(318): Xaa at position 318 is Ala, Gly, or Pro
  SITE (320)..(320): Xaa at position 320 is Tyr, Phe, Met, His, Ile, Leu, Val Ala, or Gly
  SITE (322)..(322): Xaa at position 322 is Val, Ala, Gly, Leu, or Ile
  SITE (336)..(336): Xaa at position 336 is Ile, Ala, Val, Leu, or Gly
  SITE (346)..(346): Xaa at position 346 is Cys, Ala, Val, Gly, Ser, or Thr
  SITE (360)..(360): Xaa at position 360 is Ile, Ala, Val, Leu, or Gly
  SITE (362)..(362): Xaa at position 362 is Val, Ala, Gly, Leu, or Ile
  SITE (369)..(369): Xaa at position 369 is Ile, Ala, Val, Leu, or Gly
  SITE (371)..(371): Xaa at position 371 is Ile, Ala, Val, Leu, or Gly
  SITE (373)..(373): Xaa at position 373 is Met, Ile, Leu, Val, Ala, or Gly
  SITE (380)..(380): Xaa at position 380 is Phe, Tyr, Met, His, Ile, Leu, Val Ala, or Gly
  SITE (382)..(382): Xaa at position 382 is Ala, Gly, or Pro
MGYPEVERRELLPAAAPRERGSQGCGCGGAPARAGEGNSCLLFLGFFGLSLALHLLTLCCYLELRSELRRERGAESRLGGSGTPGTSGTXSSLGGLDPDSPITSHLGQPSPKQQPLEPGEAALHSDSQDGHQMALLNFFFPDEKPYSEEESRRVRRNKRSKSNEGADGPVKNKKKGKKAGPPGPNGPPGPPGPPGPQGPPGIPGIPGIPGTTVMGPPGPPGPPGPQGPPGLQGPSGAADKAGTRENQPAVXHXQGQGSAIQXKNDLSGGVXNDWSRITMNPKVFKLHPRSGEXEXLVDGTXFXYSQXEXYXXNXTDFXSXEXVVDEKPFLQCTRSXETGKTNYNTXYTAGVCLLKARQKXAXKMVHADXSXNXSKHTTFXGXIRLGEAPAS

SEQ ID NO: 820 - protein, 1545 aa, Homo sapiens
  SITE (668)..(668): Xaa at position 668 is Ala, Gly, or Pro
  SITE (669)..(669): Xaa at position 669 is Val, Ala, Gly, Leu, or Ile
  SITE (680)..(680): Xaa at position 680 is Leu, Ala, Val, Gly, or Ile
  SITE (683)..(683): Xaa at position 683 is Ala, Gly, or Pro
  SITE (684)..(684): Xaa at position 684 is Met, Ile, Leu, Val, Ala, or Gly
  SITE (1330)..(1330): Xaa at position 1330 is Ile, Ala, Val, Leu, or Gly
  SITE (1332)..(1332): Xaa at position 1332 is Val, Ala, Gly, Leu, or Ile
  SITE (1333)..(1333): Xaa at position 1333 is Val, Ala, Gly, Leu, or Ile
  SITE (1343)..(1343): Xaa at position 1343 is Leu, Ala, Val, Gly, or Ile
  SITE (1347)..(1347): Xaa at position 1347 is Leu, Ala, Val, Gly, or Ile
  SITE (1348)..(1348): Xaa at position 1348 is Phe, Tyr, Met, His, Ile, Leu Val, Ala, or Gly
MLEKFCNSTFWNSSFLDSPEADLPLCFEQTVLVWIPLGYLWLLAPWQLLHVYKSRTKRSSTTKLYLAKQVFVGFLLILAAIELALVLTEDSGQATVPAVRYTNPSLYLGTWLLVLLIQYSRQWCVQKNSWFLSLFWILSILCGTFQFQTLIRTLLQGDNSNLAYSCLFFISYGFQILILIFSAFSENNESSNNPSSIASFLSSITYSWYDSIILKGYKRPLTLEDVWEVDEEMKTKTLVSKFETHMKRELQKARRALQRRQEKSSQQNSGARLPGLNKNQSQSQDALVLEDVEKKKKKSGTKKDVPKSWLMKALFKTFYMVLLKSFLLKLVNDIFTFVSPQLLKLLISFASDRDTYLWIGYLCAILLFTAALIQSFCLQCYFQLCFKLGVKVRTAIMASVYKKALTLSNLARKEYTVGETVNLMSVDAQKLMDVTNFMHMLWSSVLQIVLSIFFLWRELGPSVLAGVGVMVLVIPINAILSTKSKTIQVKNMKNKDKRLKIMNEILSGIKILKYFAWEPSFRDQVQNLRKKELKNLLAFSQLQCVVIFVFQLTPVLVSVVTFSVYVLVDSNNILDAQKAFTSITLFNILRFPLSMLPMMISSMLQASVSTERLEKYLGGDDLDTSAIRHDCNFDKAMQFSEASFTWEHDSEATVRDVNLDIMAGQLVXXIGPVGSGKSSXISXXLGEMENVHGHITIKGTTAYVPQQSWIQNGTIKDNILFGTEFNEKRYQQVLEACALLPDLEMLPGGDLAEIGEKGINLSGGQKQRISLARATYQNLDIYLLDDPLSAVDAHVGKHIFNKVLGPNGLLKGKTRLLVTHSMHFLPQVDEIVVLGNGTIVEKGSYSALLAKKGEFAKNLKTFLRHTGPEEEATVHDGSEEEDDDYGLISSVEEIPEDAASITMRRENSFRRTLSRSSRSNGRHLKSLRNSLKTRNVNSLKEDEELVKGQKLIKKEFIETGKVKFSIYLEYLQAIGLFSIFFIILAFVMNSVAFIGSNLWLSAWTSDSKIFNSTDYPASQRDMRVGVYGALGLAQGIFVFIAHFWSAFGFVHASNILHKQLLNNILRAPMRFFDTTPTGRIVNRFAGDISTVDDTLPQSLRSWITCFLGIISTLVMICMATPVFTIIVIPLGIIYVSVQMFYVSTSRQLRRLDSVTRSPIYSHFSETVSGLPVIRAFEHQQRFLKHNEVRIDTNQKCVFSWITSNRWLAIRLELVGNLTVFFSALMMVIYRDTLSGDTVGFVLSNALNITQTLNWLVRMTSEIETNIVAVERITEYTKVENEAPWVTDKRPPPDWPSKGKIQFNNYQVRYRPELDLVLRGITCDIGSMEKXGXXGRTGAGKSSXTNCXXRILEAAGGQIIIDGVDIASIGLHDLREKLTIIPQDPILFSGSLRMNLDPFNNYSDEEIWKALELAHLKSFVASLQLGLSHEVTEAGGNLSIGQRQLLCLGRALLRKSKILVLDEATAAVDLETDNLIQTTIQNEFAHCTVITIAHRLHTIMDSDKVMVLDNGKIIECGSPEELLQIPGPFYFMAKEAGIENVNSTKF

SEQ ID NO: 821 - protein, 283 aa, Homo sapiens
  SITE (53)..(53): Xaa at position 53 is Cys, Ala, Val, Gly, Ser, or Thr
  SITE (54)..(54): Xaa at position 54 is Cys, Ala, Val, Gly, Ser, or Thr
  SITE (57)..(57): Xaa at position 57 is Cys, Ala, Val, Gly, Ser, or Thr
MEPPGDWGPPPWRSTPKTDVLRLVLYLTFLGAPCYAPALPSCKEDEYPVGSEXXPKXSPGYRVKEACGELTGTVCEPCPPGTYIAHLNGLSKCLQCQMCDPAMGLRASRNCSRTENAVCGCSPGHFCIVQDGDHCAACRAYATSSPGQRVQKGGTESQDTLCQNCPPGTFSPNGTLEECQHQTKCSWLVTKAGAGTSSSHWVWWFLSGSLVIVIVCSTVGLIICVKRRKPRGDVVKVIVSVQRKRQEAEGEATVIEALQAPPDVTTVAVEETIPSFTGRSPNH

SEQ ID NO: 822 - protein, 612 aa, Homo sapiens
  SITE (444)..(444): Xaa at position 444 is Cys, Ala, Val, Gly, Ser, or Thr
  SITE (451)..(451): Xaa at position 451 is Leu, Ala, Val, Gly, or Ile
  SITE (476)..(476): Xaa at position 476 is Cys, Ala, Val, Gly, Ser, or Thr
  SITE (483)..(483): Xaa at position 483 is Ile, Ala, Val, Leu, or Gly
  SITE (494)..(494): Xaa at position 494 is Ala, Gly, or Pro
  SITE (500)..(500): Xaa at position 500 is Phe, Tyr, Met, His, Ile, Leu, Val Ala, or Gly
  SITE (524)..(524): Xaa at position 524 is Cys, Ala, Val, Gly, Ser, or Thr
MSHPSWLPPKSTGEPLGHVPARMETTHSFGNPSISVSTQQPPKKFAPVVAPKPKYNPYKQPGGEGDFLPPPPPPLDDSSALPSISGNFPPPPPLDEEAFKVQGNPGGKTLEERRSSLDAEIDSLTSILADLECSSPYKPRPPQSSTGSTASPPVSTPVTGHKRMVIPNQPPLTATKKSTLKPQPAPQAGPIPVAPIGTLKPQPQPVPASYTTASTSSRPTFNVQVKSAQPSPHYMAAPSSGQIYGSGPQGYNTQPVPVSGQCPPPSTRGGMDYAYIPPPGLQPEPGYGYAPNQGRYYEGYYAAGPGYGGRNDSDPTYGQQGHPNTWKREPGYTPPGAGNQNPPGMYPVTGPKKTYITDPVSAPCAPPLQPKGGHSGQLGPSSVAPSFRPEDELEHLTKKMLYDMENPPADEYFGRCARCGENVVGEGTGCTAMDQVFHVDCFTXIICNNKXRGQPFYAVEKKAYCEPCYINTLEQXNVCSKPXMERILRATGKXYHPHCXTCVMCHRSLDGIPFTVDAGGLIHXIEDFHKKFAPRCSVCKEPIMPAPGQEETVRIVALDRDFHVHCYRCEDCGGLLSEGDNQGCYPLDGHILCKTCNSARIRVLTAKASTDL

SEQ ID NO: 823 - protein, 445 aa, Homo sapiens
  SITE (61)..(61): Xaa at position 61 is Leu, Ala, Val, Gly, or Ile
  SITE (62)..(62): Xaa at position 62 is Tyr, Phe, Met, His, Ile, Leu, Val Ala, or Gly
  SITE (97)..(97): Xaa at position 97 is Trp, Tyr, Phe, Met, His, Ile, Leu Val, Ala, or Gly
  SITE (112)..(112): Xaa at position 112 is Phe, Tyr, Met, His, Ile, Leu, Val Ala, or Gly
  SITE (113)..(113): Xaa at position 113 is Val, Ala, Gly, Leu, or Ile
  SITE (119)..(119): Xaa at position 119 is Leu, Ala, Val, Gly, or Ile
  SITE (120)..(120): Xaa at position 120 is Cys, Ala, Val, Gly, Ser, or Thr
  SITE (131)..(131): Xaa at position 131 is Leu, Ala, Val, Gly, or Ile
  SITE (132)..(132): Xaa at position 132 is Ala, Gly, or Pro
  SITE (133)..(133): Xaa at position 133 is Ile, Ala, Val, Leu, or Gly
  SITE (135)..(135): Xaa at position 135 is Ile, Ala, Val, Leu, or Gly
  SITE (136)..(136): Xaa at position 136 is Phe, Tyr, Met, His, Ile, Leu, Val Ala, or Gly
  SITE (137)..(137): Xaa at position 137 is Leu, Ala, Val, Gly, or Ile
  SITE (138)..(138): Xaa at position 138 is Cys, Ala, Val, Gly, Ser, or Thr
  SITE (146)..(146): Xaa at position 146 is Cys, Ala, Val, Gly, Ser, or Thr
  SITE (147)..(147): Xaa at position 147 is Phe, Tyr, Met, His, Ile, Leu, Val Ala, or Gly
  SITE (154)..(154): Xaa at position 154 is Phe, Tyr, Met, His, Ile, Leu, Val Ala, or Gly
  SITE (155)..(155): Xaa at position 155 is Leu, Ala, Val, Gly, or Ile
  SITE (156)..(156): Xaa at position 156 is Ile, Ala, Val, Leu, or Gly
  SITE (157)..(157): Xaa at position 157 is Val, Ala, Gly, Leu, or Ile
  SITE (163)..(163): Xaa at position 163 is Leu, Ala, Val, Gly, or Ile
  SITE (165)..(165): Xaa at position 165 is Ile, Ala, Val, Leu, or Gly
  SITE (169)..(169): Xaa at position 169 is Phe, Tyr, Met, His, Ile, Leu, Val Ala, or Gly
  SITE (172)..(172): Xaa at position 172 is Met, Ile, Leu, Val, Ala, or Gly
  SITE (174)..(174): Xaa at position 174 is Val, Ala, Gly, Leu, or Ile
  SITE (179)..(179): Xaa at position 179 is Ile, Ala, Val, Leu, or Gly
  SITE (180)..(180): Xaa at position 180 is Cys, Ala, Val, Gly, Ser, or Thr
  SITE (181)..(181): Xaa at position 181 is Val, Ala, Gly, Leu, or Ile
  SITE (182)..(182): Xaa at position 182 is Ile, Ala, Val, Leu, or Gly
  SITE (186)..(186): Xaa at position 186 is Met, Ile, Leu, Val, Ala, or Gly
  SITE (188)..(188): Xaa at position 188 is Phe, Tyr, Met, His, Ile, Leu, Val Ala, or Gly
  SITE (190)..(190): Xaa at position 190 is Ile, Ala, Val, Leu, or Gly
  SITE (199)..(199): Xaa at position 199 is Tyr, Phe, Met, His, Ile, Leu, Val Ala, or Gly
  SITE (200)..(200): Xaa at position 200 is Ile, Ala, Val, Leu, or Gly
  SITE (201)..(201): Xaa at position 201 is Leu, Ala, Val, Gly, or Ile
  SITE (203)..(203): Xaa at position 203 is Val, Ala, Gly, Leu, or Ile
  SITE (208)..(208): Xaa at position 208 is Phe, Tyr, Met, His, Ile, Leu, Val Ala, or Gly
  SITE (221)..(221): Xaa at position 221 is Leu, Ala, Val, Gly, or Ile
  SITE (227)..(227): Xaa at position 227 is Phe, Tyr, Met, His, Ile, Leu, Val Ala, or Gly
  SITE (239)..(239): Xaa at position 239 is Val, Ala, Gly, Leu, or Ile
  SITE (245)..(245): Xaa at position 245 is Val, Ala, Gly, Leu, or Ile
  SITE (246)..(246): Xaa at position 246 is Ile, Ala, Val, Leu, or Gly
  SITE (253)..(253): Xaa at position 253 is Leu, Ala, Val, Gly, or Ile
  SITE (256)..(256): Xaa at position 256 is Ala, Gly, or Pro
  SITE (263)..(263): Xaa at position 263 is Phe, Tyr, Met, His, Ile, Leu, Val Ala, or Gly
  SITE (265)..(265): Xaa at position 265 is Val, Ala, Gly, Leu, or Ile
  SITE (267)..(267): Xaa at position 267 is Ala, Gly, or Pro
  SITE (268)..(268): Xaa at position 268 is Trp, Tyr, Phe, Met, His, Ile, Leu Val, Ala, or Gly
  SITE (277)..(277): Xaa at position 277 is Tyr, Phe, Met, His, Ile, Leu, Val Ala, or Gly
  SITE (300)..(300): Xaa at position 300 is Val, Ala, Gly, Leu, or Ile
  SITE (301)..(301): Xaa at position 301 is Leu, Ala, Val, Gly, or Ile
  SITE (303)..(303): Xaa at position 303 is Ala, Gly, or Pro
  SITE (313)..(313): Xaa at position 313 is Ala, Gly, or Pro
  SITE (315)..(315): Xaa at position 315 is Phe, Tyr, Met, His, Ile, Leu, Val Ala, or Gly
  SITE (317)..(317): Xaa at position 317 is Ile, Ala, Val, Leu, or Gly
  SITE (342)..(342): Xaa at position 342 is Phe, Tyr, Met, His, Ile, Leu, Val Ala, or Gly
  SITE (345)..(345): Xaa at position 345 is Leu, Ala, Val, Gly, or Ile
  SITE (397)..(397): Xaa at position 397 is Ala, Gly, or Pro
  SITE (398)..(398): Xaa at position 398 is Phe, Tyr, Met, His, Ile, Leu, Val Ala, or Gly
  SITE (400)..(400): Xaa at position 400 is Phe, Tyr, Met, His, Ile, Leu, Val Ala, or Gly
  SITE (423)..(423): Xaa at position 423 is Tyr, Phe, Met, His, Ile, Leu, Val Ala, or Gly
MAELKYISGFGNECSSEDPRCPGSLPEGQNNPQVCPYNLYAEQLSGSAFTCPRSTNKRSWXXRILPSVSHKPFESIDEGQVTHNWDEVDPDPNQLRXKPFEIPKASQKKVDXXSGLHTXXGAGDIKSNNGXXXHXXXXNTSMENRXXYNSDGDXXXXPQKGNXLXYTEXGKXLXQPNEXXXXQRGXRXSXDVFEETRGXXXEXYGVHXELPDLGPIGANGXANPRDXLIPIAWYEDRQXPGGYTXXNKYQGKXFAXKQDVSPXNXVXXHGNYTPYKXNLKNFMVINSVAFDHADPSIFTXXTXKSVRPGVAIXDXVXFPPRWGVADKTFRPPYYHRNCMSEXMGXIRGHYEAKQGGFLPGGGSLHSTMTPHGPDADCFEKASKVKLAPERIADGTMXXMXESSLSLAVTKWGLKASRCLDENXHKCWEPLKSHFTPNSRNPAEPN

SEQ ID NO: 824 - protein, 263 aa, Homo sapiens
  SITE (41)..(41): Xaa at position 41 is Phe, Tyr, Met, His, Ile, Leu, Val Ala, or Gly
  SITE (45)..(45): Xaa at position 45 is Leu, Ala, Val, Gly, or Ile
  SITE (61)..(61): Xaa at position 61 is Phe, Tyr, Met, His, Ile, Leu, Val Ala, or Gly
  SITE (62)..(62): Xaa at position 62 is Val, Ala, Gly, Leu, or Ile
  SITE (118)..(118): Xaa at position 118 is Cys, Ala, Val, Gly, Ser, or Thr
  SITE (120)..(120): Xaa at position 120 is Leu, Ala, Val, Gly, or Ile
  SITE (131)..(131): Xaa at position 131 is Tyr, Phe, Met, His, Ile, Leu, Val Ala, or Gly
  SITE (135)..(135): Xaa at position 135 is Val, Ala, Gly, Leu, or Ile
  SITE (152)..(152): Xaa at position 152 is Phe, Tyr, Met, His, Ile, Leu, Val Ala, or Gly
  SITE (176)..(176): Xaa at position 176 is Val, Ala, Gly, Leu, or Ile
  SITE (178)..(178): Xaa at position 178 is Leu, Ala, Val, Gly, or Ile
  SITE (183)..(183): Xaa at position 183 is Leu, Ala, Val, Gly, or Ile
  SITE (205)..(205): Xaa at position 205 is Val, Ala, Gly, Leu, or Ile
  SITE (241)..(241): Xaa at position 241 is Ala, Gly, or Pro
  SITE (243)..(243): Xaa at position 243 is Ile, Ala, Val, Leu, or Gly
MMPKHCFLGFLISFFLTGVAGTQSTHESLKPQRVQFQSRNXHNIXQWQPGRALTGNSSVYXXQYKIMFSCSMKSSHQKPSGCWQHISCNFPGCRTLAKYGQRQWKNKEDCWGTQELSXDXTSETSDIQEPXYGRXRAASAGSYSEWSMTPRXTPWWETKIDPPVMNITQVNGSLLXIXHAPNXPYRYQKEKNVSIEDYYELLYRXFIINNSLEKEQKVYEGAHRAVEIEALTPHSSYCVVXEXYQPMLDRRSQRSEERCVEIP

SEQ ID NO: 825 - protein, 665 aa, Homo sapiens
  SITE (4)..(4): Xaa at position 4 is Ala, Gly, or Pro
  SITE (6)..(6): Xaa at position 6 is Val, Ala, Gly, Leu, or Ile
  SITE (18)..(18): Xaa at position 18 is Leu, Ala, Val, Gly, or Ile
  SITE (20)..(20): Xaa at position 20 is Ile, Ala, Val, Leu, or Gly
  SITE (26)..(26): Xaa at position 26 is Ile, Ala, Val, Leu, or Gly
  SITE (37)..(37): Xaa at position 37 is Trp, Tyr, Phe, Met, His, Ile, Leu Val, Ala, or Gly
  SITE (48)..(48): Xaa at position 48 is Phe, Tyr, Met, His, Ile, Leu, Val Ala, or Gly
  SITE (53)..(53): Xaa at position 53 is Val, Ala, Gly, Leu, or Ile
  SITE (103)..(103): Xaa at position 103 is Cys, Ala, Val, Gly, Ser, or Thr
  SITE (105)..(105): Xaa at position 105 is Val, Ala, Gly, Leu, or Ile
  SITE (117)..(117): Xaa at position 117 is Leu, Ala, Val, Gly, or Ile
  SITE (119)..(119): Xaa at position 119 is Leu, Ala, Val, Gly, or Ile
  SITE (125)..(125): Xaa at position 125 is Ile, Ala, Val, Leu, or Gly
  SITE (127)..(127): Xaa at position 127 is Val, Ala, Gly, Leu, or Ile
  SITE (140)..(140): Xaa at position 140 is Leu, Ala, Val, Gly, or Ile
  SITE (147)..(147): Xaa at position 147 is Phe, Tyr, Met, His, Ile, Leu, Val Ala, or Gly
  SITE (152)..(152): Xaa at position 152 is Ile, Ala, Val, Leu, or Gly
  SITE (272)..(272): Xaa at position 272 is Cys, Ala, Val, Gly, Ser, or Thr
  SITE (274)..(274): Xaa at position 274 is Val, Ala, Gly, Leu, or Ile
  SITE (286)..(286): Xaa at position 286 is Leu, Ala, Val, Gly, or Ile
  SITE (288)..(288): Xaa at position 288 is Ile, Ala, Val, Leu, or Gly
  SITE (294)..(294): Xaa at position 294 is Val, Ala, Gly, Leu, or Ile
  SITE (307)..(307): Xaa at position 307 is Trp, Tyr, Phe, Met, His, Ile, Leu Val, Ala, or Gly
  SITE (318)..(318): Xaa at position 318 is Phe, Tyr, Met, His, Ile, Leu, Val Ala, or Gly
  SITE (323)..(323): Xaa at position 323 is Val, Ala, Gly, Leu, or Ile
MVEXIXEFDYQAQHDDEXTXSVGEIXTNIRKEDGGWXEGQINGRRGLXPDNFXREIKKEMKKDPLTNKAPEKPLHEVPSGNSLLSSETILRTNKRGERRRRRXQXAFSYLPQNDDEXEXKVGDIXEXVGEVEEGWWEGVXNGKTGMXPSNFXKELSGESDELGISQDEQLSKSSLRETTGSESDGGDSSSTKSEGANGTVATAAIQPKKVKGVGFGDIFKDKPIKLRPRSIEVENDFLPVEKTIGKKLPATTATPDSSKTEMDSRTKSKDYXKXIFPYEAQNDDEXTXKEGDIXTLINKDCIDVGWXEGELNGRRGVXPDNFXKLLPPDFEKEGNRPKKPPPPSAPVIKQGAGTTERKHEIKKIPPERPEMLPNRTEEKERPEREPKLDLQKPSVPAIPPKKPRPPKTNSLSRPGALPPRRPERPVGPLTHTRGDSPKIDLAGSSLSGILDKDLSDRSNDIDLEGFDSVVSSTEKLSHPTTSRPKATGRRPPSQSLTSSSLSSPDIFDSPSPEEDKEEHISLAHRGVDASKKTSKTVTISQVSDNKASLPPKPGTMAAGGGGPAPLSSAAPSPLSSSLGTAGHRANSPSLFGTEGKPKMEPAASSQAAVEELRTQVRELRSIIETMKDQQKREIKQLLSELDEEKKIRLRLQMEVNDIKKALQSK

SEQ ID NO: 826 - protein, 866 aa, Homo sapiens
  SITE (48)..(48): Xaa at position 48 is Leu, Ala, Val, Gly, or Ile
  SITE (93)..(93): Xaa at position 93 is Val, Ala, Gly, Leu, or Ile
  SITE (94)..(94): Xaa at position 94 is Ala, Gly, or Pro
  SITE (96)..(96): Xaa at position 96 is Ile, Ala, Val, Leu, or Gly
  SITE (98)..(98): Xaa at position 98 is Trp, Tyr, Phe, Met, His, Ile, Leu Val, Ala, or Gly
  SITE (112)..(112): Xaa at position 112 is Ala, Gly, or Pro
  SITE (114)..(114): Xaa at position 114 is Leu, Ala, Val, Gly, or Ile
  SITE (129)..(129): Xaa at position 129 is Phe, Tyr, Met, His, Ile, Leu, Val Ala, or Gly
  SITE (135)..(135): Xaa at position 135 is Leu, Ala, Val, Gly, or Ile
  SITE (144)..(144): Xaa at position 144 is Phe, Tyr, Met, His, Ile, Leu, Val Ala, or Gly
  SITE (149)..(149): Xaa at position 149 is Phe, Tyr, Met, His, Ile, Leu, Val Ala, or Gly
  SITE (150)..(150): Xaa at position 150 is Val, Ala, Gly, Leu, or Ile
  SITE (151)..(151): Xaa at position 151 is Val, Ala, Gly, Leu, or Ile
  SITE (157)..(157): Xaa at position 157 is Tyr, Phe, Met, His, Ile, Leu, Val Ala, or Gly
  SITE (159)..(159): Xaa at position 159 is Val, Ala, Gly, Leu, or Ile
  SITE (161)..(161): Xaa at position 161 is Val, Ala, Gly, Leu, or Ile
  SITE (163)..(163): Xaa at position 163 is His, Phe, Tyr, Lys, Arg, Gly, Ser Thr, Ala, Val, Leu, Ile, Asn, Met, or Gln
  SITE (182)..(182): Xaa at position 182 is Val, Ala, Gly, Leu, or Ile
  SITE (190)..(190): Xaa at position 190 is Met, Ile, Leu, Val, Ala, or Gly
  SITE (196)..(196): Xaa at position 196 is Cys, Ala, Val, Gly, Ser, or Thr
  SITE (217)..(217): Xaa at position 217 is Leu, Ala, Val, Gly, or Ile
  SITE (219)..(219): Xaa at position 219 is Val, Ala, Gly, Leu, or Ile
  SITE (221)..(221): Xaa at position 221 is Phe, Tyr, Met, His, Ile, Leu, Val Ala, or Gly
  SITE (230)..(230): Xaa at position 230 is Tyr, Phe, Met, His, Ile, Leu, Val Ala, or Gly
  SITE (232)..(232): Xaa at position 232 is Ile, Ala, Val, Leu, or Gly
  SITE (234)..(234): Xaa at position 234 is Leu, Ala, Val, Gly, or Ile
  SITE (281)..(281): Xaa at position 281 is Val, Ala, Gly, Leu, or Ile
  SITE (283)..(283): Xaa at position 283 is Ile, Ala, Val, Leu, or Gly
  SITE (287)..(287): Xaa at position 287 is Phe, Tyr, Met, His, Ile, Leu, Val Ala, or Gly
MGAARSPPSAVPGPLLGLLLLLLGVLAPGGASLRLLDHRALVCSQPGXNCTVKNSTCLDDSWIHPRNLTPSSPKDLQIQLHFAHTQQGDLFPXXHXEXTLQTDASILYLEGXEXSVLQLNTNERLCVRXEFLSKXRHHHRRWRXTFSHXXXDPDQEXEXTXHXLPKPIPDGDPNHQSKNFLXPDCEHARXKVTTPXMSSGSLWDPNITVETLEAHQXRXSXTLWNESTHXQXLXTSFPHMENHSCFEHMHHIPAPRPEEFHQRSNVTLTLRNLKGCCRHQXQXQPFXSSCLNDCLRHSATVSCPEMPDTPEPIPDYMPLWVYWFITGISILLVGSVILLIVCMTWRLAGPGSEKYSDDTKYTDGLPAADLIPPPLKPRKVWIIYSADHPLYVDVVLKFAQFLLTACGTEVALDLLEEQAISEAGVMTWVGRQKQEMVESNSKIIVLCSRGTRAKWQALLGRGAPVRLRCDHGKPVGDLFTAAMNMILPDFKRPACFGTYVVCYFSEVSCDGDVPDLFGAAPRYPLMDRFEEVYFRIQDLEMFQPGRMHRVGELSGDNYLRSPGGRQLRAALDRFRDWQVRCPDWFECENLYSADDQDAPSLDEEVFEEPLLPPGTGIVKRAPLVREPGSQACLAIDPLVGEEGGAAVAKLEPHLQPRGQPAPQPLHTLVLAAEEGALVAAVEPGPLADGAAVRLALAGEGEACPLLGSPGAGRNSVLFLPVDPEDSPLGSSTPMASPDLLPEDVREHLEGLMLSLFEQSLSCQAQGGCSRPAMVLTDPHTPYEEEQRQSVQSDQGYISRSSPQPPEGLTEMEEEEEEEQDPGKPALPLSPEDLESLRSLQRQLLFRQLQKNSGWDTMGSESEGPSA

SEQ ID NO: 827 - protein, 620 aa, Homo sapiens
  SITE (55)..(55): Xaa at position 55 is Val, Ala, Gly, Leu, or Ile
  SITE (57)..(57): Xaa at position 57 is Cys, Ala, Val, Gly, Ser, or Thr
  SITE (76)..(76): Xaa at position 76 is Leu, Ala, Val, Gly, or Ile
  SITE (78)..(78): Xaa at position 78 is Leu, Ala, Val, Gly, or Ile
  SITE (83)..(83): Xaa at position 83 is Ile, Ala, Val, Leu, or Gly
  SITE (86)..(86): Xaa at position 86 is Leu, Ala, Val, Gly, or Ile
  SITE (91)..(91): Xaa at position 91 is Phe, Tyr, Met, His, Ile, Leu, Val Ala, or Gly
  SITE (97)..(97): Xaa at position 97 is Leu, Ala, Val, Gly, or Ile
  SITE (100)..(100): Xaa at position 100 is Leu, Ala, Val, Gly, or Ile
  SITE (102)..(102): Xaa at position 102 is Leu, Ala, Val, Gly, or Ile
  SITE (107)..(107): Xaa at position 107 is Val, Ala, Gly, Leu, or Ile
  SITE (114)..(114): Xaa at position 114 is Ala, Gly, or Pro
  SITE (115)..(115): Xaa at position 115 is Phe, Tyr, Met, His, Ile, Leu, Val Ala, or Gly
  SITE (118)..(118): Xaa at position 118 is Leu, Ala, Val, Gly, or Ile
  SITE (121)..(121): Xaa at position 121 is Leu, Ala, Val, Gly, or Ile
  SITE (124)..(124): Xaa at position 124 is Leu, Ala, Val, Gly, or Ile
  SITE (131)..(131): Xaa at position 131 is Leu, Ala, Val, Gly, or Ile
  SITE (138)..(138): Xaa at position 138 is Val, Ala, Gly, Leu, or Ile
  SITE (142)..(142): Xaa at position 142 is Leu, Ala, Val, Gly, or Ile
  SITE (145)..(145): Xaa at position 145 is Leu, Ala, Val, Gly, or Ile
  SITE (148)..(148): Xaa at position 148 is Leu, Ala, Val, Gly, or Ile
  SITE (150)..(150): Xaa at position 150 is Ile, Ala, Val, Leu, or Gly
  SITE (158)..(158): Xaa at position 158 is Leu, Ala, Val, Gly, or Ile
  SITE (163)..(163): Xaa at position 163 is Phe, Tyr, Met, His, Ile, Leu, Val Ala, or Gly
  SITE (166)..(166): Xaa at position 166 is Leu, Ala, Val, Gly, or Ile
  SITE (169)..(169): Xaa at position 169 is Leu, Ala, Val, Gly, or Ile
  SITE (172)..(172): Xaa at position 172 is Leu, Ala, Val, Gly, or Ile
  SITE (174)..(174): Xaa at position 174 is Val, Ala, Gly, Leu, or Ile
  SITE (179)..(179): Xaa at position 179 is Leu, Ala, Val, Gly, or Ile
  SITE (186)..(186): Xaa at position 186 is Ala, Gly, or Pro
  SITE (187)..(187): Xaa at position 187 is Phe, Tyr, Met, His, Ile, Leu, Val Ala, or Gly
  SITE (190)..(190): Xaa at position 190 is Leu, Ala, Val, Gly, or Ile
  SITE (193)..(193): Xaa at position 193 is Leu, Ala, Val, Gly, or Ile
  SITE (196)..(196): Xaa at position 196 is Leu, Ala, Val, Gly, or Ile
  SITE (198)..(198): Xaa at position 198 is Leu, Ala, Val, Gly, or Ile
  SITE (201)..(201): Xaa at position 201 is Cys, Ala, Val, Gly, Ser, or Thr
  SITE (210)..(210): Xaa at position 210 is Ala, Gly, or Pro
  SITE (211)..(211): Xaa at position 211 is Leu, Ala, Val, Gly, or Ile
  SITE (214)..(214): Xaa at position 214 is Leu, Ala, Val, Gly, or Ile
  SITE (217)..(217): Xaa at position 217 is Leu, Ala, Val, Gly, or Ile
  SITE (220)..(220): Xaa at position 220 is Leu, Ala, Val, Gly, or Ile
  SITE (222)..(222): Xaa at position 222 is Leu, Ala, Val, Gly, or Ile
  SITE (230)..(230): Xaa at position 230 is Ile, Ala, Val, Leu, or Gly
  SITE (241)..(241): Xaa at position 241 is Leu, Ala, Val, Gly, or Ile
  SITE (244)..(244): Xaa at position 244 is Leu, Ala, Val, Gly, or Ile
  SITE (246)..(246): Xaa at position 246 is Ile, Ala, Val, Leu, or Gly
  SITE (249)..(249): Xaa at position 249 is Trp, Tyr, Phe, Met, His, Ile, Leu Val, Ala, or Gly
  SITE (252)..(252): Xaa at position 252 is Leu, Ala, Val, Gly, or Ile
  SITE (259)..(259): Xaa at position 259 is Cys, Ala, Val, Gly, Ser, or Thr
  SITE (260)..(260): Xaa at position 260 is Leu, Ala, Val, Gly, or Ile
  SITE (265)..(265): Xaa at position 265 is Leu, Ala, Val, Gly, or Ile
  SITE (268)..(268): Xaa at position 268 is Leu, Ala, Val, Gly, or Ile
  SITE (270)..(270): Xaa at position 270 is Ile, Ala, Val, Leu, or Gly
  SITE (282)..(282): Xaa at position 282 is Ala, Gly, or Pro
  SITE (286)..(286): Xaa at position 286 is Leu, Ala, Val, Gly, or Ile
  SITE (289)..(289): Xaa at position 289 is Leu, Ala, Val, Gly, or Ile
  SITE (299)..(299): Xaa at position 299 is Ile, Ala, Val, Leu, or Gly
  SITE (310)..(310): Xaa at position 310 is Leu, Ala, Val, Gly, or Ile
  SITE (313)..(313): Xaa at position 313 is Leu, Ala, Val, Gly, or Ile
  SITE (318)..(318): Xaa at position 318 is Leu, Ala, Val, Gly, or Ile
  SITE (323)..(323): Xaa at position 323 is Leu, Ala, Val, Gly, or Ile
  SITE (330)..(330): Xaa at position 330 is Ala, Gly, or Pro
  SITE (331)..(331): Xaa at position 331 is Phe, Tyr, Met, His, Ile, Leu, Val Ala, or Gly
  SITE (334)..(334): Xaa at position 334 is Leu, Ala, Val, Gly, or Ile
  SITE (340)..(340): Xaa at position 340 is Leu, Ala, Val, Gly, or Ile
  SITE (342)..(342): Xaa at position 342 is Val, Ala, Gly, Leu, or Ile
  SITE (347)..(347): Xaa at position 347 is Leu, Ala, Val, Gly, or Ile
  SITE (350)..(350): Xaa at position 350 is Leu, Ala, Val, Gly, or Ile
  SITE (354)..(354): Xaa at position 354 is Val, Ala, Gly, Leu, or Ile
  SITE (361)..(361): Xaa at position 361 is Leu, Ala, Val, Gly, or Ile
  SITE (364)..(364): Xaa at position 364 is Leu, Ala, Val, Gly, or Ile
  SITE (366)..(366): Xaa at position 366 is Leu, Ala, Val, Gly, or Ile
  SITE (371)..(371): Xaa at position 371 is Leu, Ala, Val, Gly, or Ile
  SITE (377)..(377): Xaa at position 377 is Leu, Ala, Val, Gly, or Ile
  SITE (380)..(380): Xaa at position 380 is Val, Ala, Gly, Leu, or Ile
  SITE (381)..(381): Xaa at position 381 is Phe, Tyr, Met, His, Ile, Leu, Val Ala, or Gly
  SITE (387)..(387): Xaa at position 387 is Leu, Ala, Val, Gly, or Ile
  SITE (389)..(389): Xaa at position 389 is Phe, Tyr, Met, His, Ile, Leu, Val Ala, or Gly
  SITE (396)..(396): Xaa at position 396 is Cys, Ala, Val, Gly, Ser, or Thr
  SITE (402)..(402): Xaa at position 402 is Val, Ala, Gly, Leu, or Ile
  SITE (407)..(407): Xaa at position 407 is Phe, Tyr, Met, His, Ile, Leu, Val Ala, or Gly
  SITE (424)..(424): Xaa at position 424 is Ala, Gly, or Pro
  SITE (444)..(444): Xaa at position 444 is Phe, Tyr, Met, His, Ile, Leu, Val Ala, or Gly
  SITE (446)..(446): Xaa at position 446 is Cys, Ala, Val, Gly, Ser, or Thr
  SITE (458)..(458): Xaa at position 458 is Trp, Tyr, Phe, Met, His, Ile, Leu Val, Ala, or Gly
  SITE (482)..(482): Xaa at position 482 is Leu, Ala, Val, Gly, or Ile
  SITE (484)..(484): Xaa at position 484 is Val, Ala, Gly, Leu, or Ile
  SITE (487)..(487): Xaa at position 487 is Ala, Gly, or Pro
  SITE (495)..(495): Xaa at position 495 is Tyr, Phe, Met, His, Ile, Leu, Val Ala, or Gly
  SITE (497)..(497): Xaa at position 497 is Cys, Ala, Val, Gly, Ser, or Thr
  SITE (499)..(499): Xaa at position 499 is Ala, Gly, or Pro
  SITE (510)..(510): Xaa at position 510 is Ala, Gly, or Pro
  SITE (512)..(512): Xaa at position 512 is Leu, Ala, Val, Gly, or Ile
MQVSKRMLAGGVRSMPSPLLACWQPILLLVLGSVLSGSATGCPPRCECSAQDRAXLXHRKRFVAVPEGIPTETRLXDXGKNRXKTXNQDEXASFPHXEEXEXNENIXSAVEPGXXNNXFNXRTXGLRSNRXKLIPLGXFTGXSNXTKXDXSENKIVIXLDYMXQDXYNXKSXEXGDNDXVYISHRXXSGXNSXEQXTXEKXNLTSIPTEXXSHXHGXIVXRXRHLNINAXRDYSFKRLYRXKVXEXSHXPYXDTMTPNXXYGLNXTSXSXTHCNLTAVPYLXVRHXVYXRFLNLSYNPXSTIEGSMLHEXLRXQEIQXVGGQXAVVEPYXXRGXNYLRVXNXSGNQXTTXEESXFHSVGNXETXIXDSNPXACDCRXLWXXRRRWRXNXNRQQPTXATPEFXQGKEXKDFPDVLLPNYFTCRRXRIRDRKAQQVFVDEGHTVQXVXRADGDPPPAILXLSPRKHLVSAKSNGRLTVFPDGTXEXRYXQVQDNGTXLXIXANAGGNDSMPXHXHVRSYSPDWPHQPNKTFAFISNQPGEGEANSTRATVPFPFDIKTLIIATTMGFISFLGVVLFCLVLLFLWSRGKGNTKHNIEIEYVPRKSDAGISSADAPRKFNMKMI

SEQ ID NO: 828 - protein, 596 aa, Homo sapiens
  SITE (8)..(8): Xaa at position 8 is Leu, Ala, Val, Gly, or Ile
  SITE (14)..(14): Xaa at position 14 is Trp, Tyr, Phe, Met, His, Ile, Leu Val, Ala, or Gly
  SITE (28)..(28): Xaa at position 28 is Leu, Ala, Val, Gly, or Ile
  SITE (30)..(30): Xaa at position 30 is Ile, Ala, Val, Leu, or Gly
  SITE (39)..(39): Xaa at position 39 is Ala, Gly, or Pro
  SITE (49)..(49): Xaa at position 49 is Val, Ala, Gly, Leu, or Ile
  SITE (50)..(50): Xaa at position 50 is Val, Ala, Gly, Leu, or Ile
  SITE (53)..(53): Xaa at position 53 is Ile, Ala, Val, Leu, or Gly
  SITE (58)..(58): Xaa at position 58 is Ala, Gly, or Pro
  SITE (61)..(61): Xaa at position 61 is Met, Ile, Leu, Val, Ala, or Gly
  SITE (66)..(66): Xaa at position 66 is Ala, Gly, or Pro
  SITE (70)..(70): Xaa at position 70 is Ile, Ala, Val, Leu, or Gly
  SITE (77)..(77): Xaa at position 77 is Leu, Ala, Val, Gly, or Ile
  SITE (79)..(79): Xaa at position 79 is Met, Ile, Leu, Val, Ala, or Gly
  SITE (81)..(81): Xaa at position 81 is Leu, Ala, Val, Gly, or Ile
  SITE (420)..(420): Xaa at position 420 is Cys, Ala, Val, Gly, Ser, or Thr
  SITE (427)..(427): Xaa at position 427 is Ile, Ala, Val, Leu, or Gly
  SITE (432)..(432): Xaa at position 432 is Leu, Ala, Val, Gly, or Ile
  SITE (446)..(446): Xaa at position 446 is Cys, Ala, Val, Gly, Ser, or Thr
  SITE (453)..(453): Xaa at position 453 is Met, Ile, Leu, Val, Ala, or Gly
  SITE (458)..(458): Xaa at position 458 is Phe, Tyr, Met, His, Ile, Leu, Val Ala, or Gly
  SITE (459)..(459): Xaa at position 459 is Val, Ala, Gly, Leu, or Ile
  SITE (467)..(467): Xaa at position 467 is Cys, Ala, Val, Gly, Ser, or Thr
MSNYSVSXVGPAPXGFRLQGGKDFNMPXTXSSLKDGGKXAQANVRIGDXXLSXDGINXQGXTHLEXQNKXKGCTGSXNXTXQRASAAPKPEPVPVQKGEPKEVVKPVPITSPAVSKVTSTNNMAYNKAPRPFGSVSSPKVTSIPSPSSAFTPAHATTSSHASPSPVAAVTPPLFAASGLHANANLSADQSPSALSAGKTAVNVPRQPTVTSVCSETSQELAEGQRRGSQGDSKQQNGPPRKHIVERYTEFYHVPTHSDASKKRLIEDTEDWRPRTGTTQSRSFRILAQITGTEHLKESEADNTKKANNSQEPSPQLASSVASTRSMPESLDSPTSGRPGVTSLTAAAAFKPVGSTGVIKSPSWQRPNQGVPSTGRISNSATYSGSVAPANSALGQTQPSDQDTLVQRAEHIPAGKRTPMXAHCNQVXRGPFXVALGKSWHPEEFNXAHCKNTXAYIGXXEEKGALYXELCYEKFFAPECGRCQRKILGEVISALKQTWHVSCFVCVACGKPIRNNVFHLEDGEPYCETDYYALFGTICHGCEFPIEAGDMFLEALGYTWHDTCFVCSVCCESLEGQTFFSKKDKPLCKKHAHSVNF

SEQ ID NO: 829 - protein, 903 aa, Homo sapiens
  SITE (20)..(20): Xaa at position 20 is Leu, Ala, Val, Gly, or Ile
  SITE (22)..(22): Xaa at position 22 is Ile, Ala, Val, Leu, or Gly
  SITE (24)..(24): Xaa at position 24 is Val, Ala, Gly, Leu, or Ile
  SITE (43)..(43): Xaa at position 43 is Val, Ala, Gly, Leu, or Ile
  SITE (45)..(45): Xaa at position 45 is Val, Ala, Gly, Leu, or Ile
  SITE (47)..(47): Xaa at position 47 is Val, Ala, Gly, Leu, or Ile
  SITE (71)..(71): Xaa at position 71 is Val, Ala, Gly, Leu, or Ile
  SITE (73)..(73): Xaa at position 73 is Val, Ala, Gly, Leu, or Ile
  SITE (79)..(79): Xaa at position 79 is Leu, Ala, Val, Gly, or Ile
  SITE (81)..(81): Xaa at position 81 is Phe, Tyr, Met, His, Ile, Leu, Val Ala, or Gly
  SITE (83)..(83): Xaa at position 83 is Val, Ala, Gly, Leu, or Ile
  SITE (95)..(95): Xaa at position 95 is Leu, Ala, Val, Gly, or Ile
  SITE (102)..(102): Xaa at position 102 is Ile, Ala, Val, Leu, or Gly
  SITE (106)..(106): Xaa at position 106 is Leu, Ala, Val, Gly, or Ile
  SITE (113)..(113): Xaa at position 113 is Leu, Ala, Val, Gly, or Ile
  SITE (122)..(122): Xaa at position 122 is Leu, Ala, Val, Gly, or Ile
  SITE (135)..(135): Xaa at position 135 is Leu, Ala, Val, Gly, or Ile
  SITE (137)..(137): Xaa at position 137 is Ile, Ala, Val, Leu, or Gly
  SITE (139)..(139): Xaa at position 139 is Leu, Ala, Val, Gly, or Ile
  SITE (328)..(328): Xaa at position 328 is Leu, Ala, Val, Gly, or Ile
  SITE (440)..(440): Xaa at position 440 is Leu, Ala, Val, Gly, or Ile
  SITE (456)..(456): Xaa at position 456 is Phe, Tyr, Met, His, Ile, Leu, Val Ala, or Gly
  SITE (496)..(496): Xaa at position 496 is Phe, Tyr, Met, His, Ile, Leu, Val Ala, or Gly
  SITE (535)..(535): Xaa at position 535 is Phe, Tyr, Met, His, Ile, Leu, Val Ala, or Gly
  SITE (539)..(539): Xaa at position 539 is Cys, Ala, Val, Gly, Ser, or Thr
  SITE (550)..(550): Xaa at position 550 is Ile, Ala, Val, Leu, or Gly
  SITE (552)..(552): Xaa at position 552 is Val, Ala, Gly, Leu, or Ile
  SITE (558)..(558): Xaa at position 558 is Phe, Tyr, Met, His, Ile, Leu, Val Ala, or Gly
  SITE (565)..(565): Xaa at position 565 is Ile, Ala, Val, Leu, or Gly
  SITE (573)..(573): Xaa at position 573 is Leu, Ala, Val, Gly, or Ile
  SITE (579)..(579): Xaa at position 579 is Val, Ala, Gly, Leu, or Ile
  SITE (580)..(580): Xaa at position 580 is Ile, Ala, Val, Leu, or Gly
  SITE (592)..(592): Xaa at position 592 is Val, Ala, Gly, Leu, or Ile
  SITE (596)..(596): Xaa at position 596 is Trp, Tyr, Phe, Met, His, Ile, Leu Val, Ala, or Gly
  SITE (597)..(597): Xaa at position 597 is Phe, Tyr, Met, His, Ile, Leu, Val Ala, or Gly
  SITE (600)..(600): Xaa at position 600 is Leu, Ala, Val, Gly, or Ile
  SITE (611)..(611): Xaa at position 611 is Leu, Ala, Val, Gly, or Ile
  SITE (638)..(638): Xaa at position 638 is Phe, Tyr, Met, His, Ile, Leu, Val Ala, or Gly
  SITE (640)..(640): Xaa at position 640 is Phe, Tyr, Met, His, Ile, Leu, Val Ala, or Gly
  SITE (641)..(641): Xaa at position 641 is Ile, Ala, Val, Leu, or Gly
  SITE (644)..(644): Xaa at position 644 is Phe, Tyr, Met, His, Ile, Leu, Val Ala, or Gly
  SITE (645)..(645): Xaa at position 645 is Ile, Ala, Val, Leu, or Gly
  SITE (646)..(646): Xaa at position 646 is Ala, Gly, or Pro
  SITE (647)..(647): Xaa at position 647 is Met, Ile, Leu, Val, Ala, or Gly
  SITE (648)..(648): Xaa at position 648 is Ala, Gly, or Pro
  SITE (664)..(664): Xaa at position 664 is Tyr, Phe, Met, His, Ile, Leu, Val Ala, or Gly
  SITE (667)..(667): Xaa at position 667 is Ile, Ala, Val, Leu, or Gly
  SITE (677)..(677): Xaa at position 677 is Leu, Ala, Val, Gly, or Ile
  SITE (705)..(705): Xaa at position 705 is Phe, Tyr, Met, His, Ile, Leu, Val Ala, or Gly
  SITE (742)..(742): Xaa at position 742 is Ala, Gly, or Pro
  SITE (757)..(757): Xaa at position 757 is Phe, Tyr, Met, His, Ile, Leu, Val Ala, or Gly
  SITE (761)..(761): Xaa at position 761 is Phe, Tyr, Met, His, Ile, Leu, Val Ala, or Gly
  SITE (764)..(764): Xaa at position 764 is Ile, Ala, Val, Leu, or Gly
  SITE (765)..(765): Xaa at position 765 is Leu, Ala, Val, Gly, or Ile
  SITE (770)..(770): Xaa at position 770 is Leu, Ala, Val, Gly, or Ile
  SITE (773)..(773): Xaa at position 773 is Phe, Tyr, Met, His, Ile, Leu, Val Ala, or Gly
  SITE (778)..(778): Xaa at position 778 is Leu, Ala, Val, Gly, or Ile
  SITE (782)..(782): Xaa at position 782 is Leu, Ala, Val, Gly, or Ile
  SITE (793)..(793): Xaa at position 793 is Trp, Tyr, Phe, Met, His, Ile, Leu Val, Ala, or Gly
  SITE (809)..(809): Xaa at position 809 is Ile, Ala, Val, Leu, or Gly
  SITE (812)..(812): Xaa at position 812 is Phe, Tyr, Met, His, Ile, Leu, Val Ala, or Gly
  SITE (815)..(815): Xaa at position 815 is Phe, Tyr, Met, His, Ile, Leu, Val Ala, or Gly
  SITE (816)..(816): Xaa at position 816 is Val, Ala, Gly, Leu, or Ile
  SITE (825)..(825): Xaa at position 825 is Met, Ile, Leu, Val, Ala, or Gly
  SITE (827)..(827): Xaa at position 827 is Leu, Ala, Val, Gly, or Ile
  SITE (828)..(828): Xaa at position 828 is Leu, Ala, Val, Gly, or Ile
  SITE (831)..(831): Xaa at position 831 is Val, Ala, Gly, Leu, or Ile
  SITE (842)..(842): Xaa at position 842 is Phe, Tyr, Met, His, Ile, Leu, Val Ala, or Gly
  SITE (854)..(854): Xaa at position 854 is Phe, Tyr, Met, His, Ile, Leu, Val Ala, or Gly
  SITE (855)..(855): Xaa at position 855 is Cys, Ala, Val, Gly, Ser, or Thr
  SITE (856)..(856): Xaa at position 856 is Ile, Ala, Val, Leu, or Gly
  SITE (871)..(871): Xaa at position 871 is Cys, Ala, Val, Gly, Ser, or Thr
  SITE (875)..(875): Xaa at position 875 is Leu, Ala, Val, Gly, or Ile
  SITE (877)..(877): Xaa at position 877 is Leu, Ala, Val, Gly, or Ile
  SITE (886)..(886): Xaa at position 886 is Leu, Ala, Val, Gly, or Ile
  SITE (890)..(890): Xaa at position 890 is Leu, Ala, Val, Gly, or Ile
  SITE (893)..(893): Xaa at position 893 is Ala, Gly, or Pro
  SITE (894)..(894): Xaa at position 894 is Ile, Ala, Val, Leu, or Gly
MSDSGSQLGSMGSLTMKSQXQXTXISAKLKENKKNWFGPSPYXEXTXDGQSKKTEKCNNTNSPKWKQPLTXIXTPVSKXHXRXWSHQTLKSDVLXGTAALDXYETXKSNNMKXEEVVVTLQXGGDKEPTETIGDXSXCXDGLQLESEVVTNGETTCSENGVSLCLPRLECNSAISAHCNLCLPGLSDSPISASRVAGFTGASQNDDGSRSKDETRVSTNGSDDPEDAGAGENRRVSGNNSPSLSNGGFKPSRPPRPSRPPPPTPRRPASVNGSPSATSESDGSSTGSLPPTNTNTNTSEGATSGLIIPLTISGGSGPRPLNPVTQAPXPPGWEQRVDQHGRVYYVDHVEKRTTWDRPEPLPPGWERRVDNMGRIYYVDHFTRTTTWQRPTLESVRNYEQWQLQRSQLQGAMQQFNQRFIYGNQDLFATSQSKEFDPLGPXPPGWEKRTDSNGRVYXVNHNTRITQWEDPRSQGQLNEKPLPEGWEMRFTVDGIPYXVDHNRRTTTYIDPRTGKSALDNGPQIAYVRDFKAKVQYXRFWXQQLAMPQHIKXTXTRKTLXEDSFQQXMSFSPQDXRRRLWXXFPGEEGLDYGGXAREXXFLXSHEVLNPMYCXFEYAGKDNYCLQINPASYINPDHLKYXRXXGRXXXXXLFHGKFIDTGFSLPFXKRXLNKPVGLKDXESIDPEFYNSLIWVKENNIEECDLEMYXSVDKEILGEIKSHDLKPNGGNILVTEENKEEYIRMVXEWRLSRGVEEQTQAXFEGXNEXXPQQYXQYXDAKEXEVLXCGMQEIDLNDXQRHAIYRHYARTSKQXMWXWQXXKEIDNEKRXRXXQFXTGTCRLPVGGXADLMGSNGPQKXXXEKVGKENWLPRSHTXFNRXDXPPYKSYEQXKEKXLFXXEETEGFGQE

SEQ ID NO: 830 - protein, 1243 aa, Homo sapiens
  SITE (210)..(210): Xaa at position 210 is Leu, Ala, Val, Gly, or Ile
MLASPATETTVLMSQTEADLALRPPPPLGTAGQPRLGPPPRRARRFSGKAEPRPRSSRLSRRSSVDLGLLSSWSLPASPAPDPPDPPDSAGPGPARSPPPSSKEPPEGTWTEGAPVKAAEDSARPELPDSAVGPGSREPLRVPEAVALERRREQEEKEDMETQAVATSPDGRYLKFDIEIGRGSFKTVYRGLDTDTTVEVAWCELQTRKXSRAERQRFSEEVEMLKGLQHPNIVRFYDSWKSVLRGQVCIVLVTELMTSGTLKTYLRRFREMKPRVLQRWSRQILRGLHFLHSRVPPILHRDLKCDNVFITGPTGSVKIGDLGLATLKRASFAKSVIGTPEFMAPEMYEEKYDEAVDVYAFGMCMLEMATSEYPYSECQNAAQIYRKVTSGRKPNSFHKVKIPEVKEIIEGCIRTDKNERFTIQDLLAHAFFREERGVHVELAEEDDGEKPGLKLWLRMEDARRGGRPRDNQAIEFLFQLGRDAAEEVAQEMVALGLVCEADYQPVARAVRERVAAIQRKREKLRKARELEALPPEPGPPPATVPMAPGPPSVFPPEPEEPEADQHQPFLFRHASYSSTTSDCETDGYLSSSGFLDASDPALQPPGGVPSSLAESHLCLPSAFALSIPRSGPGSDFSPGDSYASDAASGLSDVGEGMGQMRRPPGRNLRRRPRSRLRVTSVSDQNDRVVECQLQTHNSKMVTFRFDLDGDSPEEIAAAMVYNEFILPSERDGFLRRIREIIQRVETLLKRDTGPMEAAEDTLSPQEEPAPLPALPVPLPDPSNEELQSSTSLEHRSWTAFSTSSSSPGTPLSPGNPFSPGTPISPGPIFPITSPPCHPSPSPFSPISSQVSSNPSPHPTSSPLPFSSSTPEFPVPLSQCPWSSLPTTSPPTFSPTCSQVTLSSPFFPPCPSTSSFPSTTAAPLLSLASAFSLAVMTVAQSLLSPSPGLLSQSPPAPPSPLPSLPLPPPVAPGGQESPSPHTAEVESEASPPPARPLPGEARLAPISEEGKPQLVGRFQVTSSKEPAEPLPLQPTSPTLSGSPKPSTPQLTSESSDTEDSAGGGPETREALAESDRAAEGLGAGVEEEGDDGKEPQVGGSPQPLSHPSPVWMNYSYSSLCLSSEESESSGEDEEFWAELQSLRQKHLSEVETLQTLQKKEIEDLYSRLGKQPPPGIVAPAAMLSSRQRRLSKGSFPTSRRNSLQRSEPPGPGIMRRNSLSGSSTGSQEQRASKGVTFAGDVGRM

SEQ ID NO: 831 - protein, 1386 aa, Homo sapiens
  SITE (143)..(143): Xaa at position 143 is Cys, Ala, Val, Gly, Ser, or Thr
  SITE (572)..(572): Xaa at position 572 is Ile, Ala, Val, Leu, or Gly
  SITE (574)..(574): Xaa at position 574 is Leu, Ala, Val, Gly, or Ile
  SITE (591)..(591): Xaa at position 591 is Ile, Ala, Val, Leu, or Gly
  SITE (616)..(616): Xaa at position 616 is Val, Ala, Gly, Leu, or Ile
  SITE (627)..(627): Xaa at position 627 is Phe, Tyr, Met, His, Ile, Leu, Val Ala, or Gly
  SITE (629)..(629): Xaa at position 629 is Val, Ala, Gly, Leu, or Ile
  SITE (631)..(631): Xaa at position 631 is Ala, Gly, or Pro
MLRYLLKTLLQMNLFADSLAGDISNSSELLLGFNSSLAALNHTLLPPGDPSLNGSRVGPEDAMPRIVEQPPDLLVSRGEPATLPCRAEGRPRPNIEWYKNGARVATVREDPRAHRLLLPSGALFFPRIVHGRRARPDEGVYTXVARNYLGAAASRNASLEVAVLRDDFRQSPGNVVVAVGEPAVLECVPPRGHPEPSVSWRKDGARLKEEEGRITIRGGKLMMSHTLKSDAGMYVCVASNMAGERESAAAEVMVLERPSFLRRPVNQVVLADAPVTFLCEVKGDPPPRLRWRKEDGELPTGRYEIRSDHSLWIGHVSAEDEGTYTCVAENSVGRAEASGSLSVHVPPQLVTQPQDQMAAPGESVAFQCETKGNPPPAIFWQKEGSQVLLFPSQSLQPTGRFSVSPRGQLNITAVQRGDAGYYVCQAVSVAGSILAKALLEIKGASLDGLPPVILQGPANQTLVLGSSVWLPCRVTGNPQPSVRWKKDGQWLQGDDLQFKTMANGTLYIANVQEMDMGFYSCVAKSSTGEATWSGWLKMREDWGVSPDPPTEPSSPPGAPSQPVVTEITKNSXTXTWKPNPQTGAAVTSYVXEAFSPAAGNTWRTVADGVQLETHTXSGLQPNTIYLXLXRXVGAWGLSEPSPVSEPVRTQDSSPSRPVEDPWRGQQGLAEVAVRLQEPIVLGPRTLQVSWTVDGPVQLVQGFRVSWRVAGPEGGSWTMLDLQSPSQQSTVLRGLPPGTQIQIKVQAQGQEGLGAESLSVTRSIPEEAPSGPPQGVAVALGGDGNSSITVSWEPPLPSQQNGVITEYQIWCLGNESRFHLNRSAAGWARSAMLRGLVPGLLYRTLVAAATSAGVGVPSAPVLVQLPSPPDLEPGLEVGAGLAVRLARVLREPAFLAGSGAACGALLLGLCAALYWRRKQRKELSHYTASFAYTPAVSFPHSEGLSGASSRPPMGLGPAPYSWLADSWPHPSRSPSAQEPRGSCCPSNPDPDDRYYNEAGISLYLAQTARGTAAPGEGPVYSTIDPAGEELQTFHGGFPQHPSGDLGPWSQYAPPEWSQGDSGAKGGKVKLLGKPVQMPSLNWPEALPPPPPSCELSCLEGPEEELEGSSEPEEWCPPMPERSHLTEPSSSGGCLVTPSRRETPSPTPSYGQQSTATLTPSPPDPPQPPTDMPHLHQMPRRVPLGPSSPLSVSQPMLGIREARPAGLGAGPAASPHLSPSPAPSTASSAPGRTWQGNGEMTPPLQGPRARFRKKPKALPYRRENSPGDLPPPPLPPPEEEASWALELRAAGSMSSLERERSGERKAVQAVPLAAQRVLHPDEEAWLPYSRPSFLSRGQGTSTCSTAGSNSSRGSSSSRGSRGPGRSRSRSQSRSQSQRPGQKRREEPR

SEQ ID NO: 832 - protein, 1036 aa, Homo sapiens
  SITE (10)..(10): Xaa at position 10 is Leu, Ala, Val, Gly, or Ile
  SITE (14)..(14): Xaa at position 14 is Leu, Ala, Val, Gly, or Ile
  SITE (25)..(25): Xaa at position 25 is Phe, Tyr, Met, His, Ile, Leu, Val Ala, or Gly
  SITE (29)..(29): Xaa at position 29 is Leu, Ala, Val, Gly, or Ile
  SITE (54)..(54): Xaa at position 54 is Leu, Ala, Val, Gly, or Ile
  SITE (55)..(55): Xaa at position 55 is Ala, Gly, or Pro
  SITE (58)..(58): Xaa at position 58 is Met, Ile, Leu, Val, Ala, or Gly
  SITE (67)..(67): Xaa at position 67 is Ala, Gly, or Pro
  SITE (68)..(68): Xaa at position 68 is Trp, Tyr, Phe, Met, His, Ile, Leu Val, Ala, or Gly
  SITE (69)..(69): Xaa at position 69 is Ala, Gly, or Pro
  SITE (70)..(70): Xaa at position 70 is Met, Ile, Leu, Val, Ala, or Gly
  SITE (71)..(71): Xaa at position 71 is Ala, Gly, or Pro
  SITE (74)..(74): Xaa at position 74 is Ile, Ala, Val, Leu, or Gly
  SITE (75)..(75): Xaa at position 75 is Phe, Tyr, Met, His, Ile, Leu, Val Ala, or Gly
  SITE (87)..(87): Xaa at position 87 is Ala, Gly, or Pro
MKMASTRCKXARYXEDLEDVDLKKXKMHXEDYPPQKGCIPLPRGQTEKADHVDXXTLXIDFNGEEKXXXXXVWXXAAINRRDLYEKXKRDEPKWGSDNARVSNPTVICQEDSIEEEWMGLLEYLSRISICKMKKDYRKKYRKYVRSRFQCIEDRNARLGESVSLNKRYTRLRLIKEHRSQQEREQELLAIGKTKTCESPVSPIKMELLFDPDDEHSEPVHTVVFQGAAGIGKTILARKMMLDWASGTLYQDRFDYLFYIHCREVSLVTQRSLGDLIMSCCPDPNPPIHKIVRKPSRILFLMDGFDELQGAFDEHIGPLCTDWQKAERGDILLSSLIRKKLLPEASLLITTRPVALEKLQHLLDHPRHVEILGFSEAKRKEYFFKYFSDEAQARAAFSLIQENEVLFTMCFIPLVCWIVCTGLKQQMESGKSLAQTSKTTTAVYVFFLSSLLQPRGGSQEHGLCAHLWGLCSLAADGIWNQKILFEESDLRNHGLQKADVSAFLRMNLFQKEVDCEKFYSFIHMTFQEFFAAMYYLLEEEKEGRTNVPGSRLKLPSRDVTVLLENYGKFEKGYLIFVVRFLFGLVNQERTSYLEKKLSCKISQQIRLELLKWIEVKAKAKKLQIQPSQLELFYCLYEMQEEDFVQRAMDYFPKIEINLSTRMDHMVSSFCIENCHRVESLSLGFLHNMPKEEEEEEKEGRHLDMVQCVLPSSSHAACSHGLVNSHLTSSFCRGLFSVLSTSQSLTELDLSDNSLGDPGMRVLCETLQHPGCNIRRLWLGRCGLSHECCFDISLVLSSNQKLVELDLSDNALGDFGIRLLCVGLKHLLCNLKKLWLVSCCLTSACCQDLASVLSTSHSLTRLYVGENALGDSGVAILCEKAKNPQCNLQKLGLVNSGLTSVCCSALSSVLSTNQNLTHLYLRGNTLGDKGIKLLCEGLLHPDCKLQVLELDNCNLTSHCCWDLSTLLTSSQSLRKLSLGNNDLGDLGVMMFCEVLKQQSCLLQNLGLSEMYFNYETKSALETLQEEKPELTVVFEPSW

SEQ ID NO: 833 - protein, 163 aa, Homo sapiens
  SITE (102)..(102): Xaa at position 102 is Cys, Ala, Val, Gly, Ser, or Thr
  SITE (107)..(107): Xaa at position 107 is Cys, Ala, Val, Gly, Ser, or Thr
  SITE (129)..(129): Xaa at position 129 is Val, Ala, Gly, Leu, or Ile
MTVKTLHGPAMVKYLLLSILGLAFLSEAAARKIPKVGHTFFQKPESCPPVPGGSMKLDIGIINENQRVSMSRNIESRSTSPWNYTVTWDPNRYPSEVVQAQXRNLGXINAQGKEDISMNSVPIQQETLXVRRKHQGCSVSFQLEKVLVTVGCTCVTPVIHHVQ

SEQ ID NO: 834 - protein, 696 aa, Homo sapiens
  SITE (61)..(61): Xaa at position 61 is Tyr, Phe, Met, His, Ile, Leu, Val Ala, or Gly
  SITE (63)..(63): Xaa at position 63 is Leu, Ala, Val, Gly, or Ile
  SITE (65)..(65): Xaa at position 65 is Leu, Ala, Val, Gly, or Ile
  SITE (70)..(70): Xaa at position 70 is Leu, Ala, Val, Gly, or Ile
  SITE (73)..(73): Xaa at position 73 is Leu, Ala, Val, Gly, or Ile
  SITE (78)..(78): Xaa at position 78 is Phe, Tyr, Met, His, Ile, Leu, Val Ala, or Gly
  SITE (87)..(87): Xaa at position 87 is Leu, Ala, Val, Gly, or Ile
  SITE (89)..(89): Xaa at position 89 is Met, Ile, Leu, Val, Ala, or Gly
  SITE (94)..(94): Xaa at position 94 is Leu, Ala, Val, Gly, or Ile
  SITE (101)..(101): Xaa at position 101 is Ala, Gly, or Pro
  SITE (102)..(102): Xaa at position 102 is Phe, Tyr, Met, His, Ile, Leu, Val Ala, or Gly
  SITE (105)..(105): Xaa at position 105 is Leu, Ala, Val, Gly, or Ile
  SITE (108)..(108): Xaa at position 108 is Val, Ala, Gly, Leu, or Ile
  SITE (111)..(111): Xaa at position 111 is Leu, Ala, Val, Gly, or Ile
  SITE (113)..(113): Xaa at position 113 is Ile, Ala, Val, Leu, or Gly
  SITE (118)..(118): Xaa at position 118 is Ile, Ala, Val, Leu, or Gly
  SITE (121)..(121): Xaa at position 121 is Phe, Tyr, Met, His, Ile, Leu, Val Ala, or Gly
  SITE (129)..(129): Xaa at position 129 is Leu, Ala, Val, Gly, or Ile
  SITE (132)..(132): Xaa at position 132 is Leu, Ala, Val, Gly, or Ile
  SITE (135)..(135): Xaa at position 135 is Leu, Ala, Val, Gly, or Ile
  SITE (137)..(137): Xaa at position 137 is Ala, Gly, or Pro
  SITE (142)..(142): Xaa at position 142 is Leu, Ala, Val, Gly, or Ile
  SITE (149)..(149): Xaa at position 149 is Ala, Gly, or Pro
  SITE (150)..(150): Xaa at position 150 is Phe, Tyr, Met, His, Ile, Leu, Val Ala, or Gly
  SITE (153)..(153): Xaa at position 153 is Leu, Ala, Val, Gly, or Ile
  SITE (156)..(156): Xaa at position 156 is Leu, Ala, Val, Gly, or Ile
  SITE (159)..(159): Xaa at position 159 is Leu, Ala, Val, Gly, or Ile
  SITE (161)..(161): Xaa at position 161 is Leu, Ala, Val, Gly, or Ile
  SITE (166)..(166): Xaa at position 166 is Ile, Ala, Val, Leu, or Gly
  SITE (173)..(173): Xaa at position 173 is Val, Ala, Gly, Leu, or Ile
  SITE (174)..(174): Xaa at position 174 is Phe, Tyr, Met, His, Ile, Leu, Val Ala, or Gly
  SITE (182)..(182): Xaa at position 182 is Leu, Ala, Val, Gly, or Ile
  SITE (184)..(184): Xaa at position 184 is Leu, Ala, Val, Gly, or Ile
  SITE (189)..(189): Xaa at position 189 is Leu, Ala, Val, Gly, or Ile
  SITE (197)..(197): Xaa at position 197 is Val, Ala, Gly, Leu, or Ile
  SITE (198)..(198): Xaa at position 198 is Leu, Ala, Val, Gly, or Ile
  SITE (201)..(201): Xaa at position 201 is Ile, Ala, Val, Leu, or Gly
  SITE (207)..(207): Xaa at position 207 is Ile, Ala, Val, Leu, or Gly
  SITE (208)..(208): Xaa at position 208 is Leu, Ala, Val, Gly, or Ile
  SITE (209)..(209): Xaa at position 209 is Leu, Ala, Val, Gly, or Ile
  SITE (214)..(214): Xaa at position 214 is Trp, Tyr, Phe, Met, His, Ile, Leu Val, Ala, or Gly
  SITE (216)..(216): Xaa at position 216 is Cys, Ala, Val, Gly, Ser, or Thr
  SITE (220)..(220): Xaa at position 220 is Leu, Ala, Val, Gly, or Ile
  SITE (223)..(223): Xaa at position 223 is Leu, Ala, Val, Gly, or Ile
  SITE (234)..(234): Xaa at position 234 is Ala, Gly, or Pro
  SITE (239)..(239): Xaa at position 239 is Val, Ala, Gly, Leu, or Ile
  SITE (241)..(241): Xaa at position 241 is Cys, Ala, Val, Gly, Ser, or Thr
  SITE (247)..(247): Xaa at position 247 is Leu, Ala, Val, Gly, or Ile
  SITE (252)..(252): Xaa at position 252 is Leu, Ala, Val, Gly, or Ile
  SITE (387)..(387): Xaa at position 387 is Ile, Ala, Val, Leu, or Gly
  SITE (390)..(390): Xaa at position 390 is Ile, Ala, Val, Leu, or Gly
  SITE (395)..(395): Xaa at position 395 is Phe, Tyr, Met, His, Ile, Leu, Val Ala, or Gly
  SITE (401)..(401): Xaa at position 401 is Leu, Ala, Val, Gly, or Ile
  SITE (404)..(404): Xaa at position 404 is Leu, Ala, Val, Gly, or Ile
  SITE (406)..(406): Xaa at position 406 is Leu, Ala, Val, Gly, or Ile
  SITE (411)..(411): Xaa at position 411 is Ile, Ala, Val, Leu, or Gly
  SITE (419)..(419): Xaa at position 419 is Phe, Tyr, Met, His, Ile, Leu, Val Ala, or Gly
  SITE (422)..(422): Xaa at position 422 is Leu, Ala, Val, Gly, or Ile
  SITE (425)..(425): Xaa at position 425 is Leu, Ala, Val, Gly, or Ile
  SITE (428)..(428): Xaa at position 428 is Leu, Ala, Val, Gly, or Ile
  SITE (430)..(430): Xaa at position 430 is Met, Ile, Leu, Val, Ala, or Gly
  SITE (435)..(435): Xaa at position 435 is Leu, Ala, Val, Gly, or Ile
  SITE (438)..(438): Xaa at position 438 is Leu, Ala, Val, Gly, or Ile
  SITE (443)..(443): Xaa at position 443 is Phe, Tyr, Met, His, Ile, Leu, Val Ala, or Gly
  SITE (446)..(446): Xaa at position 446 is Leu, Ala, Val, Gly, or Ile
  SITE (449)..(449): Xaa at position 449 is Leu, Ala, Val, Gly, or Ile
  SITE (452)..(452): Xaa at position 452 is Leu, Ala, Val, Gly, or Ile
  SITE (454)..(454): Xaa at position 454 is Val, Ala, Gly, Leu, or Ile
  SITE (459)..(459): Xaa at position 459 is Ile, Ala, Val, Leu, or Gly
  SITE (462)..(462): Xaa at position 462 is Ile, Ala, Val, Leu, or Gly
  SITE (467)..(467): Xaa at position 467 is Phe, Tyr, Met, His, Ile, Leu, Val Ala, or Gly
  SITE (470)..(470): Xaa at position 470 is Met, Ile, Leu, Val, Ala, or Gly
  SITE (473)..(473): Xaa at position 473 is Leu, Ala, Val, Gly, or Ile
  SITE (476)..(476): Xaa at position 476 is Leu, Ala, Val, Gly, or Ile
  SITE (478)..(478): Xaa at position 478 is Leu, Ala, Val, Gly, or Ile
  SITE (483)..(483): Xaa at position 483 is Leu, Ala, Val, Gly, or Ile
  SITE (490)..(490): Xaa at position 490 is Val, Ala, Gly, Leu, or Ile
  SITE (491)..(491): Xaa at position 491 is Phe, Tyr, Met, His, Ile, Leu, Val Ala, or Gly
  SITE (496)..(496): Xaa at position 496 is Leu, Ala, Val, Gly, or Ile
  SITE (499)..(499): Xaa at position 499 is Leu, Ala, Val, Gly, or Ile
  SITE (501)..(501): Xaa at position 501 is Leu, Ala, Val, Gly, or Ile
  SITE (506)..(506): Xaa at position 506 is Phe, Tyr, Met, His, Ile, Leu, Val Ala, or Gly
  SITE (514)..(514): Xaa at position 514 is Val, Ala, Gly, Leu, or Ile
  SITE (515)..(515): Xaa at position 515 is Leu, Ala, Val, Gly, or Ile
  SITE (524)..(524): Xaa at position 524 is Ile, Ala, Val, Leu, or Gly
  SITE (526)..(526): Xaa at position 526 is Leu, Ala, Val, Gly, or Ile
  SITE (531)..(531): Xaa at position 531 is Trp, Tyr, Phe, Met, His, Ile, Leu Val, Ala, or Gly
  SITE (537)..(537): Xaa at position 537 is Ile, Ala, Val, Leu, or Gly
  SITE (540)..(540): Xaa at position 540 is Phe, Tyr, Met, His, Ile, Leu, Val Ala, or Gly
  SITE (556)..(556): Xaa at position 556 is Leu, Ala, Val, Gly, or Ile
  SITE (569)..(569): Xaa at position 569 is Phe, Tyr, Met, His, Ile, Leu, Val Ala, or Gly
MLLWILLLETSLCFAAGNVTGDVCKEKICSCNEIEGDLHVDCEKKGFTSLQRFTAPTSQFXHXFXHGNSXTRXFPNEXANFYNAVSXHXENNGXHEIVPGXXLGXQLXKRXHXNNNKXKSXRKQTFLGXDDXEYXQXDFNLXRDIDPGXXQDXNKXEVXIXNDNLXSTLPANXXQYVPITHXDXRGNRXKTLPYEEXXEQXPGIAEXXXEDNPXDXTCDXLSXKEWLENIPKNXLIGRXVXEAPTRXQGKDXNETTEQDLCPLKNRVDSSLPAPPAQEETFAPGPLPTPFKTNGQEDHATPGSAPNGGTKIPGNWQIKIRPTAAIATGSSRNKPLANSLPCPGGCSCDHIPGSGLKMNCNNRNVSSLADLKPKLSNVQELFLRDNKXHSXRKSHXVDYKNXILXDXGNNNXATVENNTXKNXLDXRWXYXDSNYXDTXSREKXAGXQNXEYXNXEYNAXQLXLPGTXNAXPKXRIXIXNNNLXRSLPVDXXAGVSXSKXSXHNNYXMYLPVAGXXDQLTSIIQXDXHGNPXECSCTXVPXKQWAERLGSEVLMSDXKCETPVNFFRKDXMLLSNDEICPQLYARISPTLTSHSKNSTGLAETGTHSNSYLDTSRVSISVLVPGLLLVFVTSAFTVVGMLVFILRNRKRSKRRDANSSASEINSLQTVCDSSYWHNGPYNADGAHRVYDCGSHSLSD

SEQ ID NO: 835 - protein, 1491 aa, Homo sapiens
  SITE (318)..(318): Xaa at position 318 is Phe, Tyr, Met, His, Ile, Leu, Val Ala, or Gly
  SITE (377)..(377): Xaa at position 377 is Tyr, Phe, Met, His, Ile, Leu, Val Ala, or Gly
  SITE (475)..(475): Xaa at position 475 is Leu, Ala, Val, Gly, or Ile
  SITE (496)..(496): Xaa at position 496 is Leu, Ala, Val, Gly, or Ile
  SITE (498)..(498): Xaa at position 498 is Ile, Ala, Val, Leu, or Gly
  SITE (507)..(507): Xaa at position 507 is Ala, Gly, or Pro
  SITE (513)..(513): Xaa at position 513 is Met, Ile, Leu, Val, Ala, or Gly
  SITE (518)..(518): Xaa at position 518 is Val, Ala, Gly, Leu, or Ile
  SITE (519)..(519): Xaa at position 519 is Ile, Ala, Val, Leu, or Gly
  SITE (520)..(520): Xaa at position 520 is Val, Ala, Gly, Leu, or Ile
  SITE (522)..(522): Xaa at position 522 is Val, Ala, Gly, Leu, or Ile
  SITE (527)..(527): Xaa at position 527 is Val, Ala, Gly, Leu, or Ile
  SITE (528)..(528): Xaa at position 528 is Leu, Ala, Val, Gly, or Ile
  SITE (535)..(535): Xaa at position 535 is Val, Ala, Gly, Leu, or Ile
  SITE (548)..(548): Xaa at position 548 is Val, Ala, Gly, Leu, or Ile
  SITE (550)..(550): Xaa at position 550 is Leu, Ala, Val, Gly, or Ile
  SITE (552)..(552): Xaa at position 552 is Leu, Ala, Val, Gly, or Ile
  SITE (553)..(553): Xaa at position 553 is Cys, Ala, Val, Gly, Ser, or Thr
  SITE (646)..(646): Xaa at position 646 is Ile, Ala, Val, Leu, or Gly
  SITE (686)..(686): Xaa at position 686 is Ile, Ala, Val, Leu, or Gly
  SITE (689)..(689): Xaa at position 689 is Val, Ala, Gly, Leu, or Ile
  SITE (694)..(694): Xaa at position 694 is Val, Ala, Gly, Leu, or Ile
  SITE (702)..(702): Xaa at position 702 is Val, Ala, Gly, Leu, or Ile
  SITE (715)..(715): Xaa at position 715 is Val, Ala, Gly, Leu, or Ile
  SITE (717)..(717): Xaa at position 717 is Leu, Ala, Val, Gly, or Ile
  SITE (719)..(719): Xaa at position 719 is Val, Ala, Gly, Leu, or Ile
  SITE (842)..(842): Xaa at position 842 is Ile, Ala, Val, Leu, or Gly
  SITE (844)..(844): Xaa at position 844 is Leu, Ala, Val, Gly, or Ile
  SITE (865)..(865): Xaa at position 865 is Ile, Ala, Val, Leu, or Gly
  SITE (867)..(867): Xaa at position 867 is Ile, Ala, Val, Leu, or Gly
  SITE (876)..(876): Xaa at position 876 is Ala, Gly, or Pro
  SITE (888)..(888): Xaa at position 888 is Leu, Ala, Val, Gly, or Ile
  SITE (889)..(889): Xaa at position 889 is Ile, Ala, Val, Leu, or Gly
  SITE (891)..(891): Xaa at position 891 is Val, Ala, Gly, Leu, or Ile
  SITE (896)..(896): Xaa at position 896 is Val, Ala, Gly, Leu, or Ile
  SITE (904)..(904): Xaa at position 904 is Val, Ala, Gly, Leu, or Ile
  SITE (911)..(911): Xaa at position 911 is Ala, Gly, or Pro
  SITE (917)..(917): Xaa at position 917 is Val, Ala, Gly, Leu, or Ile
  SITE (919)..(919): Xaa at position 919 is Leu, Ala, Val, Gly, or Ile
  SITE (921)..(921): Xaa at position 921 is Val, Ala, Gly, Leu, or Ile
  SITE (999)..(999): Xaa at position 999 is Val, Ala, Gly, Leu, or Ile
  SITE (1001)..(1001): Xaa at position 1001 is Ile, Ala, Val, Leu, or Gly
  SITE (1038)..(1038): Xaa at position 1038 is Ile, Ala, Val, Leu, or Gly
  SITE (1047)..(1047): Xaa at position 1047 is Ala, Gly, or Pro
  SITE (1053)..(1053): Xaa at position 1053 is Leu, Ala, Val, Gly, or Ile
  SITE (1062)..(1062): Xaa at position 1062 is Val, Ala, Gly, Leu, or Ile
  SITE (1075)..(1075): Xaa at position 1075 is Ile, Ala, Val, Leu, or Gly
  SITE (1086)..(1086): Xaa at position 1086 is Val, Ala, Gly, Leu, or Ile
  SITE (1088)..(1088): Xaa at position 1088 is Leu, Ala, Val, Gly, or Ile
  SITE (1153)..(1153): Xaa at position 1153 is Val, Ala, Gly, Leu, or Ile
  SITE (1166)..(1166): Xaa at position 1166 is Leu, Ala, Val, Gly, or Ile
  SITE (1176)..(1176): Xaa at position 1176 is Leu, Ala, Val, Gly, or Ile
  SITE (1187)..(1187): Xaa at position 1187 is Ala, Gly, or Pro
  SITE (1193)..(1193): Xaa at position 1193 is Met, Ile, Leu, Val, Ala, or Gly
  SITE (1199)..(1199): Xaa at position 1199 is Ile, Ala, Val, Leu, or Gly
  SITE (1202)..(1202): Xaa at position 1202 is Ile, Ala, Val, Leu, or Gly
  SITE (1215)..(1215): Xaa at position 1215 is Ala, Gly, or Pro
  SITE (1218)..(1218): Xaa at position 1218 is Leu, Ala, Val, Gly, or Ile
  SITE (1226)..(1226): Xaa at position 1226 is Val, Ala, Gly, Leu, or Ile
  SITE (1228)..(1228): Xaa at position 1228 is Leu, Ala, Val, Gly, or Ile
  SITE (1230)..(1230): Xaa at position 1230 is Leu, Ala, Val, Gly, or Ile
MSKVIQKKNHWTSRVHECTVKRGPQGELGVTVLGGAEHGEFPYVGAVAAVEAAGLPGGGEGPRLGEGELLLEVQGVRVSGLPRYDVLGVIDSCKEAVTFKAVRQGGRLNKDLRHFLNQRFQKGSPDHELQQTIRDNLYRHAVPCTTRSPREGEVPGVDYNFLTVKEFLDLEQSGTLLEVGTYEGNYYGTPKPPSQPVSGKVITTDALHSLQSGSKQSTPKRTKSYNDMQNAGIVHAENEEEDDVPEMNSSFTADSGEQEEHTLQETALPPVNSSIIAAPITDPSQKFPQYLPLSAEDNLGPLPENWEMAYTENGEVYXIDHNTKTTSWLDPRCLNKQQKPLEECEDDEGVHTEELDSELELPAGWEKIEDPVYGIYXVDHINRKTQYENPVLEAKRKKQLEQQQQQQQQQQQQQQQQQQQQTEEWTEDHSALVPPVIPNHPPSNPEPAREVPLQGKPFFTRNPSELKGKFIHTKXRKSSRGFGFTVVGGDEPDEFXQXKSLVLDGPXALDGKXETGDXXXSXNDTCXXGHTHAQXVKIFQSIPIGASXDXEXXRGYPLPFDPDDPNTSLVTSVAILDKEPIIVNGQETYDSPASHSSKTGKVNGMKDARPSSPADVASNSSHGYPNDTVSLASSIATQPELITVHXVKGPMGFGFTIADSPGGGGQRVKQIVDSPRCRGLKEGDLXVEXNKKNXQALTHNQXVDMLVECPKGSEXTXLXQRGGLPVPKKSPKSQPLERKDSQNSSQHSVSSHRSLHTASPSHSTQVLPEFPPAEAQAPDQTDSSGQKKPDPFKIWAQSRSMYENRPMSPSPASGLSKGEREREINSTNFGECPIPDYQEQDXFXWRKETGFGFRILGGNEPGEPXYXGHIVPLGAXDTDGRLRSGDEXXCXDGTPXIGKSHQLXVQLMQQXAKQGHXNXTXRRKVVFAVPKTENEVPSPASSHHSSNQPASLTEEKRTPQGSQNSLNTVSSGSGSTSGIGSGGGGGSGVVSTVVQPYDXEXRRGENEGFGFVIVSSVSRPEAGTTFAGNACVAMPHKXGRIIEGSPXDRCGKXKVGDRILAXNGCSITNKSHSDXVNLIKEAGNTXTXRIIPGDESSNATLLTNAEKIATITTTHTPSQQGTQETRNTTKPKQESQFEFKAPQATQEQDFYTXELERGAKGFGFSXRGGREYNMDXYVLRLAEDGPXERCGKXRIGDEXLEXNGETTKNMKHSRXIEXIKNGGRRXRXFXKRGDGSVPEYDPSSDRHGPATGPQGVPEVRAGPDRRQHPSLESSYPPDLHKSSPHGEKRAHARDPKGSREYSRQPNEHHTWNGTSRKPDSGACRPKDRAPEGRRDAQAERAAAANGPKRRSPEKRREGTRSADNTLERREKHEKRRDVSPERRRERSPTRRRDGSPSRRRRSLERLLEQRRSPERRRGGSPERRAKSTDRRRARSPERRRERSLDKRNREDRASHREREEANLKQDAGRSSRHPPEQRRRPYKECSTDLSI

SEQ ID NO: 836 - protein, 588 aa, Human immunodeficiency virus 1
  SITE (13)..(13): Xaa at position 13 is Ala, Gly, or Pro
  SITE (38)..(38): Xaa at position 38 is Met, Ile, Leu, Val, Ala, or Gly
  SITE (44)..(44): Xaa at position 44 is Val, Ala, Gly, Leu, or Ile
  SITE (47)..(47): Xaa at position 47 is Met, Ile, Leu, Val, Ala, or Gly
  SITE (51)..(51): Xaa at position 51 is Ile, Ala, Val, Leu, or Gly
  SITE (63)..(63): Xaa at position 63 is Val, Ala, Gly, Leu, or Ile
  SITE (70)..(70): Xaa at position 70 is Val, Ala, Gly, Leu, or Ile
  SITE (97)..(97): Xaa at position 97 is Ile, Ala, Val, Leu, or Gly
  SITE (136)..(136): Xaa at position 136 is Leu, Ala, Val, Gly, or Ile
  SITE (167)..(167): Xaa at position 167 is Ala, Gly, or Pro
  SITE (168)..(168): Xaa at position 168 is Ile, Ala, Val, Leu, or Gly
  SITE (182)..(182): Xaa at position 182 is Cys, Ala, Val, Gly, Ser, or Thr
  SITE (185)..(185): Xaa at position 185 is Val, Ala, Gly, Leu, or Ile
  SITE (194)..(194): Xaa at position 194 is Ile, Ala, Val, Leu, or Gly
  SITE (202)..(202): Xaa at position 202 is Leu, Ala, Val, Gly, or Ile
  SITE (203)..(203): Xaa at position 203 is Leu, Ala, Val, Gly, or Ile
  SITE (213)..(213): Xaa at position 213 is Val, Ala, Gly, Leu, or Ile
  SITE (227)..(227): Xaa at position 227 is Ile, Ala, Val, Leu, or Gly
  SITE (228)..(228): Xaa at position 228 is Ile, Ala, Val, Leu, or Gly
  SITE (229)..(229): Xaa at position 229 is Val, Ala, Gly, Leu, or Ile
  SITE (231)..(231): Xaa at position 231 is Leu, Ala, Val, Gly, or Ile
  SITE (235)..(235): Xaa at position 235 is Val, Ala, Gly, Leu, or Ile
  SITE (237)..(237): Xaa at position 237 is Ile, Ala, Val, Leu, or Gly
  SITE (239)..(239): Xaa at position 239 is Cys, Ala, Val, Gly, Ser, or Thr
  SITE (269)..(269): Xaa at position 269 is Met, Ile, Leu, Val, Ala, or Gly
  SITE (274)..(274): Xaa at position 274 is Cys, Ala, Val, Gly, Ser, or Thr
  SITE (276)..(276): Xaa at position 276 is Ile, Ala, Val, Leu, or Gly
  SITE (281)..(281): Xaa at position 281 is Trp, Tyr, Phe, Met, His, Ile, Leu Val, Ala, or Gly
  SITE (285)..(285): Xaa at position 285 is Leu, Ala, Val, Gly, or Ile
  SITE (288)..(288): Xaa at position 288 is Ile, Ala, Val, Leu, or Gly
  SITE (289)..(289): Xaa at position 289 is Ala, Gly, or Pro
  SITE (292)..(292): Xaa at position 292 is Leu, Ala, Val, Gly, or Ile
  SITE (302)..(302): Xaa at position 302 is Ile, Ala, Val, Leu, or Gly
  SITE (303)..(303): Xaa at position 303 is Ile, Ala, Val, Leu, or Gly
  SITE (304)..(304): Xaa at position 304 is Phe, Tyr, Met, His, Ile, Leu, Val Ala, or Gly
  SITE (317)..(317): Xaa at position 317 is His, Phe, Tyr, Lys, Arg, Gly, Ser Thr, Ala, Val, Leu, Ile, Asn, Met, or Gln
  SITE (319)..(319): Xaa at position 319 is Phe, Tyr, Met, His, Ile, Leu, Val Ala, or Gly
  SITE (321)..(321): Xaa at position 321 is Cys, Ala, Val, Gly, Ser, or Thr
  SITE (326)..(326): Xaa at position 326 is Phe, Tyr, Met, His, Ile, Leu, Val Ala, or Gly
  SITE (328)..(328): Xaa at position 328 is Cys, Ala, Val, Gly, Ser, or Thr
  SITE (333)..(333): Xaa at position 333 is Leu, Ala, Val, Gly, or Ile
  SITE (334)..(334): Xaa at position 334 is Phe, Tyr, Met, His, Ile, Leu, Val Ala, or Gly
  SITE (359)..(359): Xaa at position 359 is Leu, Ala, Val, Gly, or Ile
  SITE (361)..(361): Xaa at position 361 is Cys, Ala, Val, Gly, Ser, or Thr
  SITE (366)..(366): Xaa at position 366 is Ile, Ala, Val, Leu, or Gly
  SITE (367)..(367): Xaa at position 367 is Ile, Ala, Val, Leu, or Gly
  SITE (373)..(373): Xaa at position 373 is Val, Ala, Gly, Leu, or Ile
  SITE (376)..(376): Xaa at position 376 is Ala, Gly, or Pro
  SITE (377)..(377): Xaa at position 377 is Met, Ile, Leu, Val, Ala, or Gly
  SITE (392)..(392): Xaa at position 392 is Ile, Ala, Val, Leu, or Gly
  SITE (395)..(395): Xaa at position 395 is Leu, Ala, Val, Gly, or Ile
  SITE (396)..(396): Xaa at position 396 is Leu, Ala, Val, Gly, or Ile
  SITE (397)..(397): Xaa at position 397 is Leu, Ala, Val, Gly, or Ile
  SITE (410)..(410): Xaa at position 410 is Ile, Ala, Val, Leu, or Gly
  SITE (411)..(411): Xaa at position 411 is Phe, Tyr, Met, His, Ile, Leu, Val Ala, or Gly
  SITE (418)..(418): Xaa at position 418 is Met, Ile, Leu, Val, Ala, or Gly
  SITE (422)..(422): Xaa at position 422 is Trp, Tyr, Phe, Met, His, Ile, Leu Val, Ala, or Gly
  SITE (426)..(426): Xaa at position 426 is Leu, Ala, Val, Gly, or Ile
  SITE (432)..(432): Xaa at position 432 is Val, Ala, Gly, Leu, or Ile
  SITE (434)..(434): Xaa at position 434 is Ile, Ala, Val, Leu, or Gly
  SITE (448)..(448): Xaa at position 448 is Val, Ala, Gly, Leu, or Ile
  SITE (491)..(491): Xaa at position 491 is Ile, Ala, Val, Leu, or Gly
  SITE (492)..(492): Xaa at position 492 is Val, Ala, Gly, Leu, or Ile
  SITE (498)..(498): Xaa at position 498 is Leu, Ala, Val, Gly, or Ile
  SITE (499)..(499): Xaa at position 499 is Leu, Ala, Val, Gly, or Ile
  SITE (501)..(501): Xaa at position 501 is Ala, Gly, or Pro
  SITE (502)..(502): Xaa at position 502 is Ile, Ala, Val, Leu, or Gly
  SITE (504)..(504): Xaa at position 504 is Ala, Gly, or Pro
  SITE (508)..(508): Xaa at position 508 is Leu, Ala, Val, Gly, or Ile
  SITE (509)..(509): Xaa at position 509 is Leu, Ala, Val, Gly, or Ile
  SITE (513)..(513): Xaa at position 513 is Val, Ala, Gly, Leu, or Ile
  SITE (516)..(516): Xaa at position 516 is Ile, Ala, Val, Leu, or Gly
  SITE (519)..(519): Xaa at position 519 is Leu, Ala, Val, Gly, or Ile
  SITE (523)..(523): Xaa at position 523 is Ile, Ala, Val, Leu, or Gly
  SITE (578)..(578): Xaa at position 578 is Ile, Ala, Val, Leu, or Gly
  SITE (585)..(585): Xaa at position 585 is Ile, Ala, Val, Leu, or Gly
AKAYDTEVHNVWXTHACVPTDPNPQEVVLVNVTENFNXWKNDMXEQXHEDXISLWDQSLKPCXKLTPLCXSLKCTDLKNDTNTNSSSGRMIMEKGEXKNCSFNISTSIRGKVQKEYAFFYKLDIIPIDNDTTSYTXTSCNTSVITQACPKVSFEPIPIHYCAPAGFXXLKCNNKTFNGTGPXTNXSTVQCTHGXRPVVSTQXXLNGSLAEEEXVIRSVNFTDNAKTXXXQXNTSXEXNXTRPNNNTRKKIRIQRGPGRAFVTIGKIGNXRQAHXNXSRAKXNATXKQXXSKXREQFGNNKTXXXKQSSGGDPEIVTXSXNXGGEFXYXNSTQXXNSTWFNSTWSTEGSNNTEGSDTITXPXRIKQXXNMWQEXGKXXYAPPISGQIRCSSNXTGXXXTRDGGNSNNESEXXRPGGGDXRDNXRSEXYKYKVXKXEPLGVAPTKAKRRXVQREKRAVGIGALFLGFLGAAGSTMGAASMTLTVQARQLLSGXXQQQNNXXRXXEXQQHXXQLTXWGXKQXQARXLAVERYLKDQQLLGIWGCSGKLICTTAVPWNASWSNKSLEQIWNNMTWMEWDREXNNYTSLXHSL

SEQ ID NO: 837 - protein, 2003 aa, Homo sapiens
  SITE (472)..(472): Xaa at position 472 is Cys, Ala, Val, Gly, Ser, or Thr
  SITE (510)..(510): Xaa at position 510 is Cys, Ala, Val, Gly, Ser, or Thr
  SITE (548)..(548): Xaa at position 548 is Cys, Ala, Val, Gly, Ser, or Thr
  SITE (586)..(586): Xaa at position 586 is Cys, Ala, Val, Gly, Ser, or Thr
  SITE (965)..(965): Xaa at position 965 is Cys, Ala, Val, Gly, Ser, or Thr
  SITE (1638)..(1638): Xaa at position 1638 is Leu, Ala, Val, Gly, or Ile
  SITE (1639)..(1639): Xaa at position 1639 is His, Phe, Tyr, Lys, Arg, Gly Ser, Thr, Ala, Val, Leu, Ile, Asn, Met, or Gln
  SITE (1641)..(1641): Xaa at position 1641 is Ala, Gly, or Pro
  SITE (1642)..(1642): Xaa at position 1642 is Ala, Gly, or Pro
  SITE (1650)..(1650): Xaa at position 1650 is Ala, Gly, or Pro
  SITE (1671)..(1671): Xaa at position 1671 is Leu, Ala, Val, Gly, or Ile
  SITE (1672)..(1672): Xaa at position 1672 is His, Phe, Tyr, Lys, Arg, Gly Ser, Thr, Ala, Val, Leu, Ile, Asn, Met, or Gln
  SITE (1674)..(1674): Xaa at position 1674 is Ala, Gly, or Pro
  SITE (1675)..(1675): Xaa at position 1675 is Val, Ala, Gly, Leu, or Ile
  SITE (1679)..(1679): Xaa at position 1679 is Ala, Gly, or Pro
  SITE (1682)..(1682): Xaa at position 1682 is Val, Ala, Gly, Leu, or Ile
  SITE (1683)..(1683): Xaa at position 1683 is Cys, Ala, Val, Gly, Ser, or Thr
  SITE (1686)..(1686): Xaa at position 1686 is Leu, Ala, Val, Gly, or Ile
  SITE (1705)..(1705): Xaa at position 1705 is Leu, Ala, Val, Gly, or Ile
  SITE (1706)..(1706): Xaa at position 1706 is Met, Ile, Leu, Val, Ala, or Gly
  SITE (1707)..(1707): Xaa at position 1707 is Leu, Ala, Val, Gly, or Ile
  SITE (1708)..(1708): Xaa at position 1708 is Ala, Gly, or Pro
  SITE (1709)..(1709): Xaa at position 1709 is Ala, Gly, or Pro
  SITE (1716)..(1716): Xaa at position 1716 is Leu, Ala, Val, Gly, or Ile
  SITE (1720)..(1720): Xaa at position 1720 is Leu, Ala, Val, Gly, or Ile
  SITE (1737)..(1737): Xaa at position 1737 is Ala, Gly, or Pro
  SITE (1738)..(1738): Xaa at position 1738 is Leu, Ala, Val, Gly, or Ile
  SITE (1739)..(1739): Xaa at position 1739 is His, Phe, Tyr, Lys, Arg, Gly Ser, Thr, Ala, Val, Leu, Ile, Asn, Met, or Gln
  SITE (1741)..(1741): Xaa at position 1741 is Ala, Gly, or Pro
  SITE (1742)..(1742): Xaa at position 1742 is Ala, Gly, or Pro
  SITE (1749)..(1749): Xaa at position 1749 is Ala, Gly, or Pro
  SITE (1750)..(1750): Xaa at position 1750 is Ala, Gly, or Pro
  SITE (1753)..(1753): Xaa at position 1753 is Leu, Ala, Val, Gly, or Ile
  SITE (1771)..(1771): Xaa at position 1771 is Leu, Ala, Val, Gly, or Ile
  SITE (1772)..(1772): Xaa at position 1772 is Phe, Tyr, Met, His, Ile, Leu Val, Ala, or Gly
  SITE (1773)..(1773): Xaa at position 1773 is Leu, Ala, Val, Gly, or Ile
  SITE (1774)..(1774): Xaa at position 1774 is Ala, Gly, or Pro
  SITE (1775)..(1775): Xaa at position 1775 is Ala, Gly, or Pro
  SITE (1782)..(1782): Xaa at position 1782 is Val, Ala, Gly, Leu, or Ile
  SITE (1783)..(1783): Xaa at position 1783 is Ala, Gly, or Pro
  SITE (1786)..(1786): Xaa at position 1786 is Leu, Ala, Val, Gly, or Ile
  SITE (1806)..(1806): Xaa at position 1806 is Val, Ala, Gly, Leu, or Ile
  SITE (1807)..(1807): Xaa at position 1807 is Ala, Gly, or Pro
  SITE (1815)..(1815): Xaa at position 1815 is Leu, Ala, Val, Gly, or Ile
MQPPSLLLLLLLLLLLCVSVVRPRGLLCGSFPEPCANGGTCLSLSLGQGTCQCAPGFLGETCQFPDPCQNAQLCQNGGSCQALLPAPLGLPSSPSPLTPSFLCTCLPGFTGERCQAKLEDPCPPSFCSKRGRCHIQASGRPQCSCMPGWTGEQCQLRDFCSANPCVNGGVCLATYPQIQCHCPPGFEGHACERDVNECFQDPGPCPKGTSCHNTLGSFQCLCPVGQEGPRCELRAGPCPPRGCSNGGTCQLMPEKDSTFHLCLCPPGFIGPDCEVNPDNCVSHQCQNGGTCQDGLDTYTCLCPETWTGWDCSEDVDECETQGPPHCRNGGTCQNSAGSFHCVCVSGWGGTSCEENLDDCIAATCAPGSTCIDRVGSFSCLCPPGRTGLLCHLEDMCLSQPCHGDAQCSTNPLTGSTLCLCQPGYSGPTCHQDLDECLMAQQGPSPCEHGGSCLNTPGSFNCLCPPGYTGSRXEADHNECLSQPCHPGSTCLDLLATFHCLCPPGLEGQLXEVETNECASAPCLNHADCHDLLNGFQCICLPGFSGTRXEEDIDECRSSPCANGGQCQDQPGAFHCKCLPGFEGPRXQTEVDECLSDPCPVGASCLDLPGAFFCLCPSGFTGQLCEVPLCAPNLCQPKQICKDQKDKANCLCPDGSPGCAPPEDNCTCHHGHCQRSSCVCDVGWTGPECEAELGGCISAPCAHGGTCYPQPSGYNCTCPTGYTGPTCSEEMTACHSGPCLNGGSCNPSPGGYYCTCPPSHTGPQCQTSTDYCVSAPCFNGGTCVNRPGTFSCLCAMGFQGPRCEGKLRPSCADSPCRNRATCQDSPQGPRCLCPTGYTGGSCQTLMDLCAQKPCPRNSHCLQTGPSFHCLCLQGWTGPLCNLPLSSCQKAALSQGIDVSSLCHNGGLCVDSGPSYFCHCPPGFQGSLCQDHVNPCESRPCQNGATCMAQPSGYLCQCAPGYDGQNXSKELDACQSQPCHNHGTCTPKPGGFHCACPPGFVGLRCEGDVDECLDQPCHPTGTAACHSLANAFYCQCLPGHTGQWCEVEIDPCHSQPCFHGGTCEATAGSPLGFICHCPKGFEGPTCSHRAPSCGFHHCHHGGLCLPSPKPGFPPRCACLSGYGGPDCLTPPAPKGCGPPSPCLYNGSCSETTGLGGPGFRCSCPHSSPGPRCQKPGAKGCEGRSGDGACDAGCSGPGGNWDGGDCSLGVPDPWKGCPSHSRCWLLFRDGQCHPQCDSEECLFDGYDCETPPACTPAYDQYCHDHFHNGHCEKGCNTAECGWDGGDCRPEDGDPEWGPSLALLVVLSPPALDQQLFALARVLSLTLRVGLWVRKDRDGRDMVYPYPGARAEEKLGGTRDPTYQERAAPQTQPLGKETDSLSAGFVVVMGVDLSRCGPDHPASRCPWDPGLLLRFLAAMAAVGALEPLLPGPLLAVHPHAGTAPPANQLPWPVLCSPVAGVILLALGALLVLQLIRRRRREHGALWLPPGFTRRPRTQSAPHRRRPPLGEDSIGLKALKPKAEVDEDGVVMCSGPEEGEEVGQAEETGPPSTCQLWSLSGGCGALPQAAMLTPPQESEMEAPDLDTRGPDGVTPLMSAVCCGEVQSGTFQGAWLGCPEPWEPLLDGGACPQAHTVGTGETPXXLXXRFSRPTAXRRLLEAGANPNQPDRAGRTPXXAXXAADXREXXQLXLRSRQTAVDARTEDGTTPXXXXXRLAVEDXVEEXIAAQADVGARDKWGKTXXXWXXAVNNARXXRSXLQAGADKDAQDNREQTPXXXXXREGAVEXXQLXLGLGAARELRDQAGLAPADXXHQRNHWDXLTLLEGAGPPEARHKATPGREAGPFPRARTVSVSVPPHGGGALPRCRTLSAGAGPRGGGACLQARTWSVDLAARGGGAYSHCRSLSGVGAGGGPTPRGRRFSAGMRGPRPNPAIMRGRYGVAAGRGGRVSTDDWPCDWVALGACGSASNIPIPPPCLTPSPERGSPQLDCGPPALQEMPINQGGEGKK

SEQ ID NO: 838 - protein, 189 aa, Homo sapiens
  SITE (6)..(6): Xaa at position 6 is Ala, Gly, or Pro
  SITE (7)..(7): Xaa at position 7 is Leu, Ala, Val, Gly, or Ile
  SITE (8)..(8): Xaa at position 8 is Val, Ala, Gly, Leu, or Ile
  SITE (9)..(9): Xaa at position 9 is Ile, Ala, Val, Leu, or Gly
  SITE (10)..(10): Xaa at position 10 is Leu, Ala, Val, Gly, or Ile
  SITE (11)..(11): Xaa at position 11 is Ala, Gly, or Pro
  SITE (14)..(14): Xaa at position 14 is Ala, Gly, or Pro
  SITE (25)..(25): Xaa at position 25 is Val, Ala, Gly, Leu, or Ile
  SITE (26)..(26): Xaa at position 26 is Met, Ile, Leu, Val, Ala, or Gly
  SITE (33)..(33): Xaa at position 33 is Val, Ala, Gly, Leu, or Ile
  SITE (36)..(36): Xaa at position 36 is Ala, Gly, or Pro
  SITE (58)..(58): Xaa at position 58 is Leu, Ala, Val, Gly, or Ile
  SITE (61)..(61): Xaa at position 61 is Ala, Gly, or Pro
  SITE (67)..(67): Xaa at position 67 is Tyr, Phe, Met, His, Ile, Leu, Val Ala, or Gly
  SITE (69)..(69): Xaa at position 69 is Val, Ala, Gly, Leu, or Ile
  SITE (70)..(70): Xaa at position 70 is Val, Ala, Gly, Leu, or Ile
  SITE (71)..(71): Xaa at position 71 is Val, Ala, Gly, Leu, or Ile
  SITE (72)..(72): Xaa at position 72 is Leu, Ala, Val, Gly, or Ile
  SITE (79)..(79): Xaa at position 79 is Ala, Gly, or Pro
  SITE (82)..(82): Xaa at position 82 is Leu, Ala, Val, Gly, or Ile
  SITE (88)..(88): Xaa at position 88 is Val, Ala, Gly, Leu, or Ile
  SITE (92)..(92): Xaa at position 92 is Leu, Ala, Val, Gly, or Ile
  SITE (102)..(102): Xaa at position 102 is Ile, Ala, Val, Leu, or Gly
  SITE (103)..(103): Xaa at position 103 is Ala, Gly, or Pro
  SITE (104)..(104): Xaa at position 104 is Ala, Gly, or Pro
  SITE (105)..(105): Xaa at position 105 is Ile, Ala, Val, Leu, or Gly
  SITE (111)..(111): Xaa at position 111 is Ala, Gly, or Pro
  SITE (112)..(112): Xaa at position 112 is Leu, Ala, Val, Gly, or Ile
  SITE (113)..(113): Xaa at position 113 is Leu, Ala, Val, Gly, or Ile
  SITE (115)..(115): Xaa at position 115 is His, Phe, Tyr, Lys, Arg, Gly, Ser Thr, Ala, Val, Leu, Ile, Asn, Met, or Gln
  SITE (117)..(117): Xaa at position 117 is Ile, Ala, Val, Leu, or Gly
  SITE (123)..(123): Xaa at position 123 is Val, Ala, Gly, Leu, or Ile
  SITE (133)..(133): Xaa at position 133 is Met, Ile, Leu, Val, Ala, or Gly
  SITE (134)..(134): Xaa at position 134 is Met, Ile, Leu, Val, Ala, or Gly
  SITE (152)..(152): Xaa at position 152 is Ile, Ala, Val, Leu, or Gly
  SITE (153)..(153): Xaa at position 153 is Leu, Ala, Val, Gly, or Ile
  SITE (164)..(164): Xaa at position 164 is Phe, Tyr, Met, His, Ile, Leu, Val Ala, or Gly
  SITE (165)..(165): Xaa at position 165 is Ala, Gly, or Pro
  SITE (168)..(168): Xaa at position 168 is Ile, Ala, Val, Leu, or Gly
  SITE (169)..(169): Xaa at position 169 is Val, Ala, Gly, Leu, or Ile
MASKRXXXXXXKGXEEMETVIPVDXXRRAGIKXTVXGLAGKDPVQCSRDVVICPDASXEDXKKEGPXDXXXXPGGNLGXQNXSESAAXKEIXKEQENRKGLXXXXCAGPTXXXAXEXGFGSKXTTHPLAKDKXXNGGHYTYSENRVEKDGLXXTSRGPGTSFEXXLAXXEALNGKEVAAQVKAPLVLKD

SEQ ID NO: 839 - protein, 126 aa, Homo sapiens
  SITE (42)..(42): Xaa at position 42 is Val, Ala, Gly, Leu, or Ile
  SITE (45)..(45): Xaa at position 45 is Val, Ala, Gly, Leu, or Ile
  SITE (46)..(46): Xaa at position 46 is Leu, Ala, Val, Gly, or Ile
  SITE (59)..(59): Xaa at position 59 is Ala, Gly, or Pro
  SITE (63)..(63): Xaa at position 63 is Met, Ile, Leu, Val, Ala, or Gly
  SITE (67)..(67): Xaa at position 67 is Val, Ala, Gly, Leu, or Ile
  SITE (70)..(70): Xaa at position 70 is Ile, Ala, Val, Leu, or Gly
  SITE (71)..(71): Xaa at position 71 is Phe, Tyr, Met, His, Ile, Leu, Val Ala, or Gly
  SITE (74)..(74): Xaa at position 74 is Ile, Ala, Val, Leu, or Gly
  SITE (75)..(75): Xaa at position 75 is Ala, Gly, or Pro
  SITE (78)..(78): Xaa at position 78 is Ala, Gly, or Pro
  SITE (82)..(82): Xaa at position 82 is Ala, Gly, or Pro
  SITE (90)..(90): Xaa at position 90 is Ile, Ala, Val, Leu, or Gly
  SITE (95)..(95): Xaa at position 95 is Ile, Ala, Val, Leu, or Gly
  SITE (98)..(98): Xaa at position 98 is Ala, Gly, or Pro
  SITE (99)..(99): Xaa at position 99 is Val, Ala, Gly, Leu, or Ile
  SITE (103)..(103): Xaa at position 103 is Leu, Ala, Val, Gly, or Ile
  SITE (108)..(108): Xaa at position 108 is Ala, Gly, or Pro
  SITE (111)..(111): Xaa at position 111 is Ala, Gly, or Pro
  SITE (118)..(118): Xaa at position 118 is Ala, Gly, or Pro
MPEPSKSAPAPKKGSKKAVTKAQKKDGKKRKRSRKESYSVYXYKXXKQVHPDTGISSKXMGIXNSFXNDXXERXXGEXSRLXHYNKRSTXTSREXQTXXRLLXPGELXKHXVSEGTKXVTKYTSSK

SEQ ID NO: 840 - protein, 504 aa, Homo sapiens
  SITE (269)..(269): Xaa at position 269 is Val, Ala, Gly, Leu, or Ile
  SITE (270)..(270): Xaa at position 270 is Trp, Tyr, Phe, Met, His, Ile, Leu Val, Ala, or Gly
  SITE (286)..(286): Xaa at position 286 is Trp, Tyr, Phe, Met, His, Ile, Leu Val, Ala, or Gly
  SITE (288)..(288): Xaa at position 288 is Ile, Ala, Val, Leu, or Gly
  SITE (298)..(298): Xaa at position 298 is Val, Ala, Gly, Leu, or Ile
  SITE (301)..(301): Xaa at position 301 is Tyr, Phe, Met, His, Ile, Leu, Val Ala, or Gly
  SITE (307)..(307): Xaa at position 307 is Phe, Tyr, Met, His, Ile, Leu, Val Ala, or Gly
  SITE (316)..(316): Xaa at position 316 is His, Phe, Tyr, Lys, Arg, Gly, Ser Thr, Ala, Val, Leu, Ile, Asn, Met, or Gln
  SITE (318)..(318): Xaa at position 318 is Leu, Ala, Val, Gly, or Ile
  SITE (327)..(327): Xaa at position 327 is Ala, Gly, or Pro
  SITE (329)..(329): Xaa at position 329 is Val, Ala, Gly, Leu, or Ile
  SITE (334)..(334): Xaa at position 334 is Leu, Ala, Val, Gly, or Ile
  SITE (336)..(336): Xaa at position 336 is Phe, Tyr, Met, His, Ile, Leu, Val Ala, or Gly
  SITE (344)..(344): Xaa at position 344 is Val, Ala, Gly, Leu, or Ile
  SITE (345)..(345): Xaa at position 345 is Ile, Ala, Val, Leu, or Gly
  SITE (347)..(347): Xaa at position 347 is Tyr, Phe, Met, His, Ile, Leu, Val Ala, or Gly
  SITE (349)..(349): Xaa at position 349 is Leu, Ala, Val, Gly, or Ile
  SITE (360)..(360): Xaa at position 360 is Ile, Ala, Val, Leu, or Gly
  SITE (363)..(363): Xaa at position 363 is Ala, Gly, or Pro
  SITE (381)..(381): Xaa at position 381 is Leu, Ala, Val, Gly, or Ile
  SITE (383)..(383): Xaa at position 383 is Val, Ala, Gly, Leu, or Ile
  SITE (388)..(388): Xaa at position 388 is Leu, Ala, Val, Gly, or Ile
  SITE (390)..(390): Xaa at position 390 is Val, Ala, Gly, Leu, or Ile
  SITE (391)..(391): Xaa at position 391 is Ile, Ala, Val, Leu, or Gly
  SITE (401)..(401): Xaa at position 401 is Ile, Ala, Val, Leu, or Gly
  SITE (403)..(403): Xaa at position 403 is Leu, Ala, Val, Gly, or Ile
  SITE (406)..(406): Xaa at position 406 is Leu, Ala, Val, Gly, or Ile
  SITE (411)..(411): Xaa at position 411 is Leu, Ala, Val, Gly, or Ile
  SITE (426)..(426): Xaa at position 426 is Val, Ala, Gly, Leu, or Ile
  SITE (429)..(429): Xaa at position 429 is Ala, Gly, or Pro
  SITE (430)..(430): Xaa at position 430 is Phe, Tyr, Met, His, Ile, Leu, Val Ala, or Gly
  SITE (431)..(431): Xaa at position 431 is Ile, Ala, Val, Leu, or Gly
  SITE (432)..(432): Xaa at position 432 is Ile, Ala, Val, Leu, or Gly
  SITE (436)..(436): Xaa at position 436 is Leu, Ala, Val, Gly, or Ile
  SITE (449)..(449): Xaa at position 449 is Val, Ala, Gly, Leu, or Ile
  SITE (476)..(476): Xaa at position 476 is Met, Ile, Leu, Val, Ala, or Gly
  SITE (486)..(486): Xaa at position 486 is Leu, Ala, Val, Gly, or Ile
  SITE (489)..(489): Xaa at position 489 is Trp, Tyr, Phe, Met, His, Ile, Leu Val, Ala, or Gly
  SITE (494)..(494): Xaa at position 494 is Met, Ile, Leu, Val, Ala, or Gly
MRFFCARCCSFGPEMPAVQLLLLACLVWDVGARTAQLRKANDQSGRCQYTFSVASPNESSCPEQSQAMSVIHNLQRDSSTQRLDLEATKARLSSLESLLHQLTLDQAARPQETQEGLQRELGTLRRERDQLETQTRELETAYSNLLRDKSVLEEEKKRLRQENENLARRLESSSQEVARLRRGQCPQTRDTARAVPPGSREVSTWNLDTLAFQELKSELTEVPASRILKESPSGYLRSGEGDTGCGELVWVGEPLTLRTAETITGKYGXXMRDPKPTYPYTQETTXRXDTVGTDVRQXFEXDLISQXMQGYPSKVXIXPRPLESTGXVXYSGSXYXQGAESRTXXRXEXNTETVKAEKEXPGXGYHGQFPYSWGGYTDIDXAXDEAGXWXXYSTDEAKGAXVXSKXNPENXELEQTWETNIRKQSXANXXXXCGTXYTVSSYTSADATXNFAYDTGTGISKTLTIPFKNRYKYSSXIDYNPLEKKXFAXDNLNXVTYDIKLSKM

SEQ ID NO: 841 - protein, 751 aa, Homo sapiens
  SITE (305)..(305): Xaa at position 305 is Leu, Ala, Val, Gly, or Ile
  SITE (449)..(449): Xaa at position 449 is Leu, Ala, Val, Gly, or Ile
  SITE (472)..(472): Xaa at position 472 is Leu, Ala, Val, Gly, or Ile
  SITE (473)..(473): Xaa at position 473 is Ile, Ala, Val, Leu, or Gly
  SITE (491)..(491): Xaa at position 491 is Ile, Ala, Val, Leu, or Gly
  SITE (526)..(526): Xaa at position 526 is Leu, Ala, Val, Gly, or Ile
MAFRTICVLVGVFICSICVKGSSQPQARVYLTFDELRETKTSEYFSLSHHPLDYRILLMDEDQDRIYVGSKDHILSLNINNISQEALSVFWPASTIKVEECKMAGKDPTHGCGNFVRVIQTFNRTHLYVCGSGAFSPVCTYLNRGRRSEDQVFMIDSKCESGKGRCSFNPNVNTVSVMINEELFSGMYIDFMGTDAAIFRSLTKRNAVRTDQHNSKWLSEPMFVDAHVIPDGTDPNDAKVYFFFKEKLTDNNRSTKQIHSMIARICPNDTGGLRSLVNKWTTFLKARLVCSVTDEDGPETHFDEXEDVFLLETDNPRTTLVYGIFTTSSSVFKGSAVCVYHLSDIQTVFNGPFAHKEGPNHQLISYQGRIPYPRPGTCPGGAFTPNMRTTKEFPDDVVTFIRNHPLMYNSIYPIHKRPLIVRIGTDYKYTKIAVDRVNAADGRYHVLFXGTDRGTVQKVVVLPTNNSVSGEXXLEELEVFKNHAPITTMKXSSKKQQLYVSSNEGVSQVSLHRCHIYGTACADCCXARDPYCAWDGHSCSRFYPTGKRRSRRQDVRHGNPLTQCRGFNLKAYRNAAEIVQYGVKNNTTFLECAPKSPQASIKWLLQKDKDRRKEVKLNERIIATSQGLLIRSVQGSDQGLYHCIATENSFKQTIAKINFKVLDSEMVAVVTDKWSPWTWASSVRALPFHPKDIMGAFSHSEMQMINQYCKDTRQQHQQGDESQKMRGDYGKLKALINSRKSRNRRNQLPES

SEQ ID NO: 842 - protein, 213 aa, Homo sapiens
  SITE (80)..(80): Xaa at position 80 is Cys, Ala, Val, Gly, Ser, or Thr
  SITE (146)..(146): Xaa at position 146 is Leu, Ala, Val, Gly, or Ile
  SITE (165)..(165): Xaa at position 165 is Cys, Ala, Val, Gly, Ser, or Thr
MQLPLALCLVCLLVHTAFRVVEGQGWQAFKNDATEIIPELGEYPEPPPELENNKTMNRAENGGRPPHHPFETKDVSEYSXRELHFTRYVTDGPCRSAKPVTELVCSGQCGPARLLPNAIGRGKWWRPSGPDFRCIPDRYRAQRVQXLCPGGEAPRARKVRLVASXKCKRLTRFHNQSELKDFGTEAARPQKGRKPRPRARSAKANQAELENAY

SEQ ID NO: 843 - protein, 212 aa, Homo sapiens
  SITE (22)..(22): Xaa at position 22 is Leu, Ala, Val, Gly, or Ile
  SITE (41)..(41): Xaa at position 41 is Ala, Gly, or Pro
  SITE (46)..(46): Xaa at position 46 is Ala, Gly, or Pro
  SITE (51)..(51): Xaa at position 51 is Ala, Gly, or Pro
  SITE (81)..(81): Xaa at position 81 is Leu, Ala, Val, Gly, or Ile
  SITE (100)..(100): Xaa at position 100 is Phe, Tyr, Met, His, Ile, Leu, Val Ala, or Gly
  SITE (103)..(103): Xaa at position 103 is Leu, Ala, Val, Gly, or Ile
  SITE (107)..(107): Xaa at position 107 is Ala, Gly, or Pro
  SITE (110)..(110): Xaa at position 110 is Leu, Ala, Val, Gly, or Ile
  SITE (114)..(114): Xaa at position 114 is Leu, Ala, Val, Gly, or Ile
  SITE (117)..(117): Xaa at position 117 is Ile, Ala, Val, Leu, or Gly
  SITE (127)..(127): Xaa at position 127 is Phe, Tyr, Met, His, Ile, Leu, Val Ala, or Gly
  SITE (134)..(134): Xaa at position 134 is Ile, Ala, Val, Leu, or Gly
  SITE (141)..(141): Xaa at position 141 is Leu, Ala, Val, Gly, or Ile
  SITE (145)..(145): Xaa at position 145 is Val, Ala, Gly, Leu, or Ile
  SITE (148)..(148): Xaa at position 148 is Val, Ala, Gly, Leu, or Ile
  SITE (160)..(160): Xaa at position 160 is Leu, Ala, Val, Gly, or Ile
  SITE (167)..(167): Xaa at position 167 is Phe, Tyr, Met, His, Ile, Leu, Val Ala, or Gly
  SITE (174)..(174): Xaa at position 174 is Phe, Tyr, Met, His, Ile, Leu, Val Ala, or Gly
  SITE (190)..(190): Xaa at position 190 is Val, Ala, Gly, Leu, or Ile
  SITE (191)..(191): Xaa at position 191 is Phe, Tyr, Met, His, Ile, Leu, Val Ala, or Gly
  SITE (194)..(194): Xaa at position 194 is Ala, Gly, or Pro
  SITE (197)..(197): Xaa at position 197 is Leu, Ala, Val, Gly, or Ile
  SITE (198)..(198): Xaa at position 198 is Ile, Ala, Val, Leu, or Gly
  SITE (204)..(204): Xaa at position 204 is Ile, Ala, Val, Leu, or Gly
  SITE (205)..(205): Xaa at position 205 is Leu, Ala, Val, Gly, or Ile
  SITE (208)..(208): Xaa at position 208 is Phe, Tyr, Met, His, Ile, Leu, Val Ala, or Gly
MRMTMEEMKNEAETTSMVSMPXYAVMYPVFNELERVNLSAXQTLRXAFIKXEKENPGLTQDIIMKILEKKSVEVNFTESLXRMAADDVEEYMIERPEPEXQDXNEKXRAXKQIXSKXPDEINDRVRXLQTIKDXASAIKEXLDTXNNXFKKYQYQNRRAXEHQKKEXVKYSKSXSDTLKTYFKDGKAINXXVSXNRXXHQTNLXXQTXKTVA

SEQ ID NO: 844 - protein, 1114 aa, Homo sapiens
  SITE (622)..(622): Xaa at position 622 is Val, Ala, Gly, Leu, or Ile
  SITE (624)..(624): Xaa at position 624 is Val, Ala, Gly, Leu, or Ile
  SITE (626)..(626): Xaa at position 626 is Trp, Tyr, Phe, Met, His, Ile, Leu Val, Ala, or Gly
  SITE (639)..(639): Xaa at position 639 is Phe, Tyr, Met, His, Ile, Leu, Val Ala, or Gly
  SITE (641)..(641): Xaa at position 641 is Val, Ala, Gly, Leu, or Ile
  SITE (668)..(668): Xaa at position 668 is Ile, Ala, Val, Leu, or Gly
  SITE (677)..(677): Xaa at position 677 is Tyr, Phe, Met, His, Ile, Leu, Val Ala, or Gly
  SITE (679)..(679): Xaa at position 679 is Phe, Tyr, Met, His, Ile, Leu, Val Ala, or Gly
  SITE (681)..(681): Xaa at position 681 is Val, Ala, Gly, Leu, or Ile
  SITE (683)..(683): Xaa at position 683 is Ala, Gly, or Pro
  SITE (701)..(701): Xaa at position 701 is Val, Ala, Gly, Leu, or Ile
  SITE (718)..(718): Xaa at position 718 is Ile, Ala, Val, Leu, or Gly
  SITE (729)..(729): Xaa at position 729 is Ile, Ala, Val, Leu, or Gly
  SITE (731)..(731): Xaa at position 731 is Leu, Ala, Val, Gly, or Ile
  SITE (748)..(748): Xaa at position 748 is Phe, Tyr, Met, His, Ile, Leu, Val Ala, or Gly
  SITE (750)..(750): Xaa at position 750 is Ile, Ala, Val, Leu, or Gly
  SITE (777)..(777): Xaa at position 777 is Ile, Ala, Val, Leu, or Gly
  SITE (786)..(786): Xaa at position 786 is Tyr, Phe, Met, His, Ile, Leu, Val Ala, or Gly
  SITE (788)..(788): Xaa at position 788 is Ile, Ala, Val, Leu, or Gly
  SITE (790)..(790): Xaa at position 790 is Met, Ile, Leu, Val, Ala, or Gly
  SITE (792)..(792): Xaa at position 792 is Cys, Ala, Val, Gly, Ser, or Thr
MLRGTMTAWRGMRPEVTLACLLLATAGCFADLNEVPQVTVQPASTVQKPGGTVILGCVVEPPRMNVTWRLNGKELNGSDDALGVLITHGTLVITALNNHTVGRYQCVARMPAGAVASVPATVTLANLQDFKLDVQHVIEVDEGNTAVIACHLPESHPKAQVRYSVKQEWLEASRGNYLIMPSGNLQIVNASQEDEGMYKCAAYNPVTQEVKTSGSSDRLRVRRSTAEAARIIYPPEAQTIIVTKGQSLILECVASGIPPPRVTWAKDGSSVTGYNKTRFLLSNLLIDTTSEEDSGTYRCMADNGVGQPGAAVILYNVQVFEPPEVTMELSQLVIPWGQSAKLTCEVRGNPPPSVLWLRNAVPLISSQRLRLSRRALRVLSMGPEDEGVYQCMAENEVGSAHAVVQLRTSRPSITPRLWQDAELATGTPPVSPSKLGNPEQMLRGQPALPRPPTSVGPASPQCPGEKGQGAPAEAPIILSSPRTSKTDSYELVWRPRHEGSGRAPILYYVVKHRKVTNSSDDWTISGIPANQHRLTLTRLDPGSLYEVEMAAYNCAGEGQTAMVTFRTGRRPKPEIMASKEQQIQRDDPGASPQSSSQPDHGRLSPPEAPDRPTISTASETSXYXTXIPRGNGGFPIQSXRXEYKKLKKVGDWILATSAIPPSRLSVEXTGLEKGTSXKXRXRXLNMLGESEPSAPSRPYVXSGYSGRVYERPVAGPYXTFTDAVNETTXMXKWMYIPASNNNTPIHGXYXYYRPTDSDNDSDYKKDMVEGDKYWHSXSHLQPETSXDXKXQXFNEGGESEFSNVMICETKARKSSGQPGRLPPPTLAPPQPPLPETIERPVGTGAMVARSSDLPYLIVGVVLGSIVLIIVTFIPFCLWRAWSKQKHTTDLGFPRSALPPSCPYTMVPLGGLPGHQASGQPYLSGISGRACANGIHMNRGCPSAAVGYPGMKPQQHCPGELQQQSDTSSLLRQTHLGNGYDPQSHQITRGPKSSPDEGSFLYTLPDDSTHQLLQPHHDCCQRQEQPAAVGQSGVRRAPDSPVLEAVWDPPFHSGPPCCLGLVPVEEVDSPDSCQVSGGDWCPQHPVGAYVGQEPGMQLSPGPLVRVSFETPPLTI

SEQ ID NO: 845 - protein, 243 aa, Homo sapiens
  SITE (108)..(108): Xaa at position 108 is Ala, Gly, or Pro
  SITE (123)..(123): Xaa at position 123 is Leu, Ala, Val, Gly, or Ile
  SITE (125)..(125): Xaa at position 125 is Phe, Tyr, Met, His, Ile, Leu, Val Ala, or Gly
  SITE (143)..(143): Xaa at position 143 is Phe, Tyr, Met, His, Ile, Leu, Val Ala, or Gly
  SITE (145)..(145): Xaa at position 145 is Cys, Ala, Val, Gly, Ser, or Thr
  SITE (151)..(151): Xaa at position 151 is Tyr, Phe, Met, His, Ile, Leu, Val Ala, or Gly
  SITE (153)..(153): Xaa at position 153 is Phe, Tyr, Met, His, Ile, Leu, Val Ala, or Gly
  SITE (155)..(155): Xaa at position 155 is Val, Ala, Gly, Leu, or Ile
  SITE (159)..(159): Xaa at position 159 is Val, Ala, Gly, Leu, or Ile
  SITE (164)..(164): Xaa at position 164 is Leu, Ala, Val, Gly, or Ile
  SITE (168)..(168): Xaa at position 168 is Leu, Ala, Val, Gly, or Ile
  SITE (199)..(199): Xaa at position 199 is Leu, Ala, Val, Gly, or Ile
  SITE (205)..(205): Xaa at position 205 is Val, Ala, Gly, Leu, or Ile
  SITE (207)..(207): Xaa at position 207 is Val, Ala, Gly, Leu, or Ile
  SITE (227)..(227): Xaa at position 227 is Phe, Tyr, Met, His, Ile, Leu, Val Ala, or Gly
MRPLLVLLLLGLAAGSPPLDDNKIPSLCPGHPGLPGTPGHHGSQGLPGRDGRDGRDGAPGAPGEKGEGGRPGLPGPRGDPGPRGEAGPAGPTGPAGECSVPPRSAFSXKRSESRVPPPSDAPXPXDRVLVNEQGHYDAVTGKXTXQVPGVXYXAXHATXYRASXQFDXVKNGESIASFFQFFGGWPKPASLSGGAMVRXEPEDQXWXQVGVGDYIGIYASIKTDSTXSGFLVYSDWHSSPVFA

SEQ ID NO: 846 - protein, 1461 aa, Homo sapiens
  SITE (44)..(44): Xaa at position 44 is Val, Ala, Gly, Leu, or Ile
  SITE (53)..(53): Xaa at position 53 is Ala, Gly, or Pro
MEARSRSAEELRRAELVEIIVETEAQTGVSGINVAGGGKEGIFXRELREDSPXARSLSLQEGDQLLSARVFFENFKYEDALRLLQCAEPYKVSFCLKRTVPTGDLALRPGTVSGYEIKGPRAKVAKLNIQSLSPVKKKKMVPGALGVPADLAPVDVEFSFPKFSRLRRGLKAEAVKGPVPAAPARRRLQLPRLRVREVAEEAQAARLAAAAPPPRKAKVEAEVAAGARFTAPQVELVGPRLPGAEVGVPQVSAPKAAPSAEAAGGFALHLPTLGLGAPAPPAVEAPAVGIQVPQVELPALPSLPTLPTLPCLETREGAVSVVVPTLDVAAPTVGVDLALPGAEVEARGEAPEVALKMPRLSFPRFGARAKEVAEAKVAKVSPEARVKGPRLRMPTFGLSLLEPRPAAPEVVESKLKLPTIKMPSLGIGVSGPEVKVPKGPEVKLPKAPEVKLPKVPEAALPEVRLPEVELPKVSEMKLPKVPEMAVPEVRLPEVELPKVSEMKLPKVPEMAVPEVRLPEVQLLKVSEMKLPKVPEMAVPEVRLPEVQLPKVSEMKLPEVSEVAVPEVRLPEVQLPKVPEMKVPEMKLPKVPEMKLPEMKLPEVQLPKVPEMAVPDVHLPEVQLPKVPEMKLPEMKLPEVKLPKVPEMAVPDVHLPEVQLPKVPEMKLPKMPEMAVPEVRLPEVQLPKVSEMKLPKVPEMAVPDVHLPEVQLPKVCEMKVPDMKLPEIKLPKVPEMAVPDVHLPEVQLPKVSEIRLPEMQVPKVPDVHLPKAPEVKLPRAPEVQLKATKAEQAEGMEFGFKMPKMTMPKLGRAESPSRGKPGEAGAEVSGKLVTLPCLQPEVDGEAHVGVPSLTLPSVELDLPGALGLQGQVPAAKMGKGERVEGPEVAAGVREVGFRVPSVEIVTPQLPAVEIEEGRLEMIETKVKPSSKFSLPKFGLSGPKVAKAEAEGAGRATKLKVSKFAISLPKARVGAEAEAKGAGEAGLLPALDLSIPQLSLDAHLPSGKVEVAGADLKFKGPRFALPKFGVRGRDTEAAELVPGVAELEGKGWGWDGRVKMPKLKMPSFGLARGKEAEVQGDRASPGEKAESTAVQLKIPEVELVTLGAQEEGRAEGAVAVSGMQLSGLKVSTAGQVVTEGHDAGLRMPPLGISLPQVELTGFGEAGTPGQQAQSTVPSAEGTAGYRVQVPQVTLSLPGAQVAGGELLVGEGVFKMPTVTVPQLELDVGLSREAQAGEAATGEGGLRLKLPTLGARARVGGEGAEEQPPGAERTFCLSLPDVELSPSGGNHAEYQVAEGEGEAGHKLKVRLPRFGLVRAKEGAEEGEKAKSPKLRLPRVGFSQSEMVTGEGSPSPEEEEEEEEEGSGEGASGRRGRVRVRLPRVGLAAPSKASRGQEGDAAPKSPVREKSPKFRFPRVSLSPKARSGSGDQEEGGLRVRLPSVGFSETGAPGPARMEGAQAAAV

SEQ ID NO: 847 - protein, 569 aa, Homo sapiens
  SITE (53)..(53): Xaa at position 53 is Tyr, Phe, Met, His, Ile, Leu, Val Ala, or Gly
  SITE (70)..(70): Xaa at position 70 is Ile, Ala, Val, Leu, or Gly
  SITE (87)..(87): Xaa at position 87 is Cys, Ala, Val, Gly, Ser, or Thr
  SITE (110)..(110): Xaa at position 110 is Val, Ala, Gly, Leu, or Ile
  SITE (127)..(127): Xaa at position 127 is Ile, Ala, Val, Leu, or Gly
  SITE (129)..(129): Xaa at position 129 is Cys, Ala, Val, Gly, Ser, or Thr
MLLLFSVILISWVSTVGGEGTLCDFPKIHHGFLYDEEDYNPFSQVPTGEVFYXSCEYNFVSPSKSFWTRXTCTEEGWSPTPKCLRMXSFPFVKNGHSESSGLIHLEGDTXQIICNTGYSLQNNEKNXSXVERGWSTPPICSFTKGECHVPILEANVDAQPKKESYKVGDVLKFSCRKNLIRVGSDSVQCYQFGWSPNFPTCKGQVRSCGPPPQLSNGEVKEIRKEEYGHNEVVEYDCNPNFIINGPKKIQCVDGEWTTLPTCVEQVKTCGYIPELEYGYVQPSVPPYQHGVSVEVNCRNEYAMIGNNMITCINGIWTELPMCVATHQLKRCKIAGVNIKTLLKLSGKEFNHNSRIRYRCSDIFRYRHSVCINGKWNPEVDCTEKREQFCPPPPQIPNAQNMTTTVNYQDGEKVAVLCKENYLLPEAKEIVCKDGRWQSLPRCVESTAYCGPPPSINNGDTTSFPLSVYPPGSTVTYRCQSFYKLQGSVTVTCRNKQWSEPPRCLDPCVVSEENMNKNNIQLKWRNDGKLYAKTGDAVEFQCKFPHKAMISSPPFRAICQEGKFEYPICE

SEQ ID NO: 848 - protein, 813 aa, Homo sapiens
  SITE (212)..(212): Xaa at position 212 is Leu, Ala, Val, Gly, or Ile
  SITE (214)..(214): Xaa at position 214 is Leu, Ala, Val, Gly, or Ile
  SITE (215)..(215): Xaa at position 215 is Tyr, Phe, Met, His, Ile, Leu, Val Ala, or Gly
  SITE (216)..(216): Xaa at position 216 is Ile, Ala, Val, Leu, or Gly
  SITE (217)..(217): Xaa at position 217 is Val, Ala, Gly, Leu, or Ile
  SITE (218)..(218): Xaa at position 218 is Ala, Gly, or Pro
  SITE (237)..(237): Xaa at position 237 is Leu, Ala, Val, Gly, or Ile
  SITE (240)..(240): Xaa at position 240 is Val, Ala, Gly, Leu, or Ile
  SITE (244)..(244): Xaa at position 244 is Val, Ala, Gly, Leu, or Ile
  SITE (247)..(247): Xaa at position 247 is Leu, Ala, Val, Gly, or Ile
  SITE (248)..(248): Xaa at position 248 is Leu, Ala, Val, Gly, or Ile
  SITE (253)..(253): Xaa at position 253 is Ile, Ala, Val, Leu, or Gly
  SITE (263)..(263): Xaa at position 263 is Trp, Tyr, Phe, Met, His, Ile, Leu Val, Ala, or Gly
  SITE (279)..(279): Xaa at position 279 is Leu, Ala, Val, Gly, or Ile
  SITE (282)..(282): Xaa at position 282 is Phe, Tyr, Met, His, Ile, Leu, Val Ala, or Gly
  SITE (283)..(283): Xaa at position 283 is Leu, Ala, Val, Gly, or Ile
  SITE (298)..(298): Xaa at position 298 is Ala, Gly, or Pro
  SITE (300)..(300): Xaa at position 300 is Leu, Ala, Val, Gly, or Ile
  SITE (301)..(301): Xaa at position 301 is Leu, Ala, Val, Gly, or Ile
  SITE (328)..(328): Xaa at position 328 is Val, Ala, Gly, Leu, or Ile
  SITE (339)..(339): Xaa at position 339 is Ala, Gly, or Pro
  SITE (340)..(340): Xaa at position 340 is Ala, Gly, or Pro
  SITE (343)..(343): Xaa at position 343 is Met, Ile, Leu, Val, Ala, or Gly
  SITE (344)..(344): Xaa at position 344 is Ala, Gly, or Pro
  SITE (347)..(347): Xaa at position 347 is Ile, Ala, Val, Leu, or Gly
  SITE (351)..(351): Xaa at position 351 is Leu, Ala, Val, Gly, or Ile
  SITE (373)..(373): Xaa at position 373 is Met, Ile, Leu, Val, Ala, or Gly
  SITE (405)..(405): Xaa at position 405 is Leu, Ala, Val, Gly, or Ile
  SITE (433)..(433): Xaa at position 433 is Cys, Ala, Val, Gly, Ser, or Thr
  SITE (444)..(444): Xaa at position 444 is Cys, Ala, Val, Gly, Ser, or Thr
  SITE (457)..(457): Xaa at position 457 is Cys, Ala, Val, Gly, Ser, or Thr
  SITE (462)..(462): Xaa at position 462 is Cys, Ala, Val, Gly, Ser, or Thr
  SITE (488)..(488): Xaa at position 488 is Cys, Ala, Val, Gly, Ser, or Thr
  SITE (495)..(495): Xaa at position 495 is Cys, Ala, Val, Gly, Ser, or Thr
MGWRPRRARGTPLLLLLLLLLLWPVPGAGVLQGHIPGQPVTPHWVLDGQPWRTVSLEEPVSKPDMGLVALEAEGQELLLELEKNHRLLAPGYIETHYGPDGQPVVLAPNHTDHCHYQGRVRGFPDSWVVLCTCSGMSGLITLSRNASYYLRPWPPRGSKDFSTHEIFRMEQLLTWKGTCGHRDPGNKAGMTSLPGGPQSRGRREARRTRKYXEXXXXXDHTLFLTRHRNLNHTKQRXLEXANYXDQXXRTLDXQVALTGLEVXTERDRSRVTQDANATXWAXXQWRRGLWAQRPHDSXQXXTGRAFQGATVGLAPVEGMCRAESSGGXSTDHSELPIGXXATXXHEXGHSXGLSHDPDGCCVEAAAESGGCVXAAATGHPFPRVFSACSRRQLRAFFRKGGGACXSNAPDPGLPVPPALCGNGFVEAGEECDXGPGQECRDLCXFAHNCSLRPGAQXAHGDXCVRCLLKPAGALCRQAMGDCDLPEFXTGTSSHXPPDVYLLDGSPCARGSGYCWDGACPTLEQQCQQLWGPGSHPAPEACFQVVNSAGDAHGNCGQDSEGHFLPCAGRDALCGKLQCQGGKPSLLAPHMVPVDSTVHLDGQEVTCRGALALPSAQLDLLGLGLVEPGTQCGPRMVCQSRRCRKNAFQELQRCLTACHSHGVCNSNHNCHCAPGWAPPFCDKPGFGGSMDSGPVQAENHDTFLLAMLLSVLLPLLPGAGLAWCCYRLPGAHLQRCSWGCRRDPACSGPKDGPHRDHPLGGVHPMELGPTATGQPWPLDPENSHEPSSHPEKPLPAVSPDPQADQVQMPRSCLW

SEQ ID NO: 849 - protein, 1473 aa, Homo sapiens
  SITE (13)..(13): Xaa at position 13 is Leu, Ala, Val, Gly, or Ile
  SITE (21)..(21): Xaa at position 21 is Leu, Ala, Val, Gly, or Ile
  SITE (24)..(24): Xaa at position 24 is Phe, Tyr, Met, His, Ile, Leu, Val Ala, or Gly
  SITE (28)..(28): Xaa at position 28 is Leu, Ala, Val, Gly, or Ile
  SITE (53)..(53): Xaa at position 53 is Val, Ala, Gly, Leu, or Ile
  SITE (54)..(54): Xaa at position 54 is Ala, Gly, or Pro
  SITE (57)..(57): Xaa at position 57 is Leu, Ala, Val, Gly, or Ile
  SITE (66)..(66): Xaa at position 66 is Ala, Gly, or Pro
  SITE (70)..(70): Xaa at position 70 is Ala, Gly, or Pro
  SITE (74)..(74): Xaa at position 74 is Trp, Tyr, Phe, Met, His, Ile, Leu Val, Ala, or Gly
  SITE (82)..(82): Xaa at position 82 is Leu, Ala, Val, Gly, or Ile
  SITE (136)..(136): Xaa at position 136 is Val, Ala, Gly, Leu, or Ile
  SITE (365)..(365): Xaa at position 365 is Phe, Tyr, Met, His, Ile, Leu, Val Ala, or Gly
  SITE (801)..(801): Xaa at position 801 is Phe, Tyr, Met, His, Ile, Leu, Val Ala, or Gly
  SITE (824)..(824): Xaa at position 824 is Ala, Gly, or Pro
  SITE (825)..(825): Xaa at position 825 is Val, Ala, Gly, Leu, or Ile
  SITE (828)..(828): Xaa at position 828 is Leu, Ala, Val, Gly, or Ile
  SITE (842)..(842): Xaa at position 842 is Leu, Ala, Val, Gly, or Ile
  SITE (844)..(844): Xaa at position 844 is Leu, Ala, Val, Gly, or Ile
  SITE (847)..(847): Xaa at position 847 is Cys, Ala, Val, Gly, Ser, or Thr
  SITE (849)..(849): Xaa at position 849 is Leu, Ala, Val, Gly, or Ile
  SITE (854)..(854): Xaa at position 854 is Cys, Ala, Val, Gly, Ser, or Thr
  SITE (870)..(870): Xaa at position 870 is Leu, Ala, Val, Gly, or Ile
  SITE (872)..(872): Xaa at position 872 is Leu, Ala, Val, Gly, or Ile
  SITE (877)..(877): Xaa at position 877 is Leu, Ala, Val, Gly, or Ile
  SITE (882)..(882): Xaa at position 882 is Ala, Gly, or Pro
  SITE (886)..(886): Xaa at position 886 is Cys, Ala, Val, Gly, Ser, or Thr
  SITE (899)..(899): Xaa at position 899 is Leu, Ala, Val, Gly, or Ile
  SITE (904)..(904): Xaa at position 904 is Cys, Ala, Val, Gly, Ser, or Thr
  SITE (910)..(910): Xaa at position 910 is Cys, Ala, Val, Gly, Ser, or Thr
  SITE (911)..(911): Xaa at position 911 is Cys, Ala, Val, Gly, Ser, or Thr
  SITE (918)..(918): Xaa at position 918 is Leu, Ala, Val, Gly, or Ile
  SITE (927)..(927): Xaa at position 927 is Leu, Ala, Val, Gly, or Ile
  SITE (929)..(929): Xaa at position 929 is Leu, Ala, Val, Gly, or Ile
  SITE (939)..(939): Xaa at position 939 is Val, Ala, Gly, Leu, or Ile
  SITE (942)..(942): Xaa at position 942 is Leu, Ala, Val, Gly, or Ile
  SITE (943)..(943): Xaa at position 943 is Cys, Ala, Val, Gly, Ser, or Thr
  SITE (946)..(946): Xaa at position 946 is Leu, Ala, Val, Gly, or Ile
  SITE (953)..(953): Xaa at position 953 is Leu, Ala, Val, Gly, or Ile
  SITE (956)..(956): Xaa at position 956 is Leu, Ala, Val, Gly, or Ile
  SITE (958)..(958): Xaa at position 958 is Leu, Ala, Val, Gly, or Ile
  SITE (967)..(967): Xaa at position 967 is Met, Ile, Leu, Val, Ala, or Gly
  SITE (971)..(971): Xaa at position 971 is Leu, Ala, Val, Gly, or Ile
  SITE (974)..(974): Xaa at position 974 is Leu, Ala, Val, Gly, or Ile
  SITE (983)..(983): Xaa at position 983 is Ile, Ala, Val, Leu, or Gly
  SITE (1379)..(1379): Xaa at position 1379 is Leu, Ala, Val, Gly, or Ile
  SITE (1382)..(1382): Xaa at position 1382 is Val, Ala, Gly, Leu, or Ile
  SITE (1389)..(1389): Xaa at position 1389 is Leu, Ala, Val, Gly, or Ile
  SITE (1390)..(1390): Xaa at position 1390 is Ile, Ala, Val, Leu, or Gly
  SITE (1393)..(1393): Xaa at position 1393 is Val, Ala, Gly, Leu, or Ile
  SITE (1396)..(1396): Xaa at position 1396 is Val, Ala, Gly, Leu, or Ile
  SITE (1399)..(1399): Xaa at position 1399 is Val, Ala, Gly, Leu, or Ile
  SITE (1400)..(1400): Xaa at position 1400 is Leu, Ala, Val, Gly, or Ile
  SITE (1403)..(1403): Xaa at position 1403 is Leu, Ala, Val, Gly, or Ile
  SITE (1408)..(1408): Xaa at position 1408 is Leu, Ala, Val, Gly, or Ile
  SITE (1416)..(1416): Xaa at position 1416 is Val, Ala, Gly, Leu, or Ile
  SITE (1426)..(1426): Xaa at position 1426 is Met, Ile, Leu, Val, Ala, or Gly
  SITE (1429)..(1429): Xaa at position 1429 is Leu, Ala, Val, Gly, or Ile
  SITE (1444)..(1444): Xaa at position 1444 is Leu, Ala, Val, Gly, or Ile
  SITE (1447)..(1447): Xaa at position 1447 is Ala, Gly, or Pro
  SITE (1448)..(1448): Xaa at position 1448 is Leu, Ala, Val, Gly, or Ile
  SITE (1459)..(1459): Xaa at position 1459 is Leu, Ala, Val, Gly, or Ile
MAGGAWGRLACYXEFLKKEEXKEXQLLXANKAHSRSSSGETPAQPEKTSGMEXXSYXVAQYGEQRXWDLXLHTXEQMGLRSXCAQAQEGAGHSPSFPYSPSEPHLGSPSQPTSTAVLMPWIHELPAGCTQGSERRXLRQLPDTSGRRWREISASLLYQALPSSPDHESPSQESPNAPTSTAVLGSWGSPPQPSLAPREQEAPGTQWPLDETSGIYYTEIREREREKSEKGRPPWAAVVGTPPQAHTSLQPHHHPWEPSVRESLCSTWPWKNEDFNQKFTQLLLLQRPHPRSQDPLVKRSWPDYVEENRGHLIEIRDLFGPGLDTQEPRIVILQGAAGIGKSTLARQVKEAWGRGQLYGDRFQHVXYFSCRELAQSKVVSLAELIGKDGTATPAPIRQILSRPERLLFILDGVDEPGWVLQEPSSELCLHWSQPQPADALLGSLLGKTILPEASFLITARTTALQNLIPSLEQARWVEVLGFSESSRKEYFYRYFTDERQAIRAFRLVKSNKELWALCLVPWVSWLACTCLMQQMKRKEKLTLTSKTTTTLCLHYLAQALQAQPLGPQLRDLCSLAAEGIWQKKTLFSPDDLRKHGLDGAIISTFLKMGILQEHPIPLSYSFIHLCFQEFFAAMSYVLEDEKGRGKHSNCIIDLEKTLEAYGIHGLFGASTTRFLLGLLSDEGEREMENIFHCRLSQGRNLMQWVPSLQLLLQPHSLESLHCLYETRNKTFLTQVMAHFEEMGMCVETDMELLVCTFCIKFSRHVKKLQLIEGRQHRSTWSPTMVVLFRWVPVTDAYWQILXSVLKVTRNLKELDLSGNSLSHSXXKSXCKTLRRPRCLLETXRXAGXGXTAEDXKDLAFGLRANQTLTEXDXSFNVXTDAGXKHLXQRLRQPSCKLQRXQLVSXGLTSDXXQDLASVXSASPSLKEXDXQQNNLDDVGXRLXXEGXRHPACKXIRXGXDQTTLSDEXRQEXRAXEQEKPQLLXFSRRKPSVMTPTEGLDTGEMSNSTSSLKRQRLGSERAASHVAQANLKLLDVSKIFPIAEIAEESSPEVVPVELLCVPSPASQGDLHTKPLGTDDDFWGPTGPVATEVVDKEKNLYRVHFPVAGSYRWPNTGLCFVMREAVTVEIEFCVWDQFLGEINPQHSWMVAGPLLDIKAEPGAVEAVHLPHFVALQGGHVDTSLFQMAHFKEEGMLLEKPARVELHHIVLENPSFSPLGVLLKMIHNALRFIPVTSVVLLYHRVHPEEVTFHLYLIPSDCSIRKAIDDLEMKFQFVRIHKPPPLTPLYMGCRYTVSGSGSGMLEILPKELELCYRSPGEDQLFSEFYVGHLGSGIRLQVKDKKDETLVWEALVKPGDLMPATTLIPPARIAVPSPLDAPQLXHFXDQYREQXXARXTSXEVXXDKXHGQVXSQEQYERXLAENTRPSQXRKXFSLSQSWDRKCKDGXYQXXKETHPHLIMEXWEKGSKKGLLPLSS

SEQ ID NO: 850 - protein, 258 aa, Mus musculus
  SITE (75)..(75): Xaa at position 75 is Leu, Ala, Val, Gly, or Ile
  SITE (77)..(77): Xaa at position 77 is Phe, Tyr, Met, His, Ile, Leu, Val Ala, or Gly
  SITE (79)..(79): Xaa at position 79 is Ile, Ala, Val, Leu, or Gly
  SITE (82)..(82): Xaa at position 82 is Leu, Ala, Val, Gly, or Ile
  SITE (88)..(88): Xaa at position 88 is Ile, Ala, Val, Leu, or Gly
  SITE (103)..(103): Xaa at position 103 is Ile, Ala, Val, Leu, or Gly
  SITE (107)..(107): Xaa at position 107 is Leu, Ala, Val, Gly, or Ile
  SITE (110)..(110): Xaa at position 110 is Leu, Ala, Val, Gly, or Ile
  SITE (140)..(140): Xaa at position 140 is Val, Ala, Gly, Leu, or Ile
  SITE (144)..(144): Xaa at position 144 is Cys, Ala, Val, Gly, Ser, or Thr
  SITE (150)..(150): Xaa at position 150 is Ala, Gly, or Pro
  SITE (158)..(158): Xaa at position 158 is Ile, Ala, Val, Leu, or Gly
  SITE (162)..(162): Xaa at position 162 is Phe, Tyr, Met, His, Ile, Leu, Val Ala, or Gly
  SITE (172)..(172): Xaa at position 172 is Leu, Ala, Val, Gly, or Ile
  SITE (182)..(182): Xaa at position 182 is Val, Ala, Gly, Leu, or Ile
MTSGSTVVTLEALFSSHLDPNLVKQVFLNKTLNASSHWLGATYQLKDLHVIDMKTSILLPAEIPTTSSSSQHFNXNXTXTNXPYSQDXAQPSTTKYQQTKRSXENAXNQXFRNSSIKSYFSDCQVLAFRSVSNNNNHTGXDSLXNFSPLXRRVDRVAXYEEXLRMTHNGTQXLNFTLDRKSXFVDGYSQNRDDDVMKNSGLPFWAIILICLAVLLVLITCLMCCFLVTVCRRKKEGDYQVQRHRLAYYLSHLDLRKLQ

SEQ ID NO: 851 - protein, 760 aa, Mus musculus
  SITE (594)..(594): Xaa at position 594 is Val, Ala, Gly, Leu, or Ile
  SITE (611)..(611): Xaa at position 611 is Leu, Ala, Val, Gly, or Ile
  SITE (614)..(614): Xaa at position 614 is Ala, Gly, or Pro
  SITE (630)..(630): Xaa at position 630 is Val, Ala, Gly, Leu, or Ile
  SITE (632)..(632): Xaa at position 632 is Met, Ile, Leu, Val, Ala, or Gly
  SITE (639)..(639): Xaa at position 639 is Val, Ala, Gly, Leu, or Ile
  SITE (641)..(641): Xaa at position 641 is Val, Ala, Gly, Leu, or Ile
  SITE (654)..(654): Xaa at position 654 is Cys, Ala, Val, Gly, Ser, or Thr
  SITE (656)..(656): Xaa at position 656 is Val, Ala, Gly, Leu, or Ile
  SITE (659)..(659): Xaa at position 659 is Leu, Ala, Val, Gly, or Ile
  SITE (661)..(661): Xaa at position 661 is Phe, Tyr, Met, His, Ile, Leu, Val Ala, or Gly
  SITE (662)..(662): Xaa at position 662 is Met, Ile, Leu, Val, Ala, or Gly
  SITE (664)..(664): Xaa at position 664 is Val, Ala, Gly, Leu, or Ile
  SITE (671)..(671): Xaa at position 671 is Phe, Tyr, Met, His, Ile, Leu, Val Ala, or Gly
  SITE (672)..(672): Xaa at position 672 is Ala, Gly, or Pro
  SITE (673)..(673): Xaa at position 673 is Phe, Tyr, Met, His, Ile, Leu, Val Ala, or Gly
  SITE (674)..(674): Xaa at position 674 is Ile, Ala, Val, Leu, or Gly
  SITE (684)..(684): Xaa at position 684 is Cys, Ala, Val, Gly, Ser, or Thr
  SITE (686)..(686): Xaa at position 686 is Val, Ala, Gly, Leu, or Ile
  SITE (687)..(687): Xaa at position 687 is Phe, Tyr, Met, His, Ile, Leu, Val Ala, or Gly
  SITE (689)..(689): Xaa at position 689 is Cys, Ala, Val, Gly, Ser, or Thr
  SITE (693)..(693): Xaa at position 693 is Ala, Gly, or Pro
  SITE (696)..(696): Xaa at position 696 is Val, Ala, Gly, Leu, or Ile
  SITE (700)..(700): Xaa at position 700 is Val, Ala, Gly, Leu, or Ile
  SITE (703)..(703): Xaa at position 703 is Ala, Gly, or Pro
  SITE (738)..(738): Xaa at position 738 is Asn, Gly, Ala, Ser, Thr, Val, Leu Ile, Gln, Asp, or Glu
MSEVLPADSGVGTLAVFMASSGSTDIANRNSPATPPNTLNLRSSHNELLNAEIKHSDAKNSTPPKCRKKYALTNIQAAMGLSDPAVQPLLGNGSANIKLVKNGENQLRKAAEQGQQDPNKNLSPAAVINLTSEKLEVKDPHPQESSGCEILPSQPRRTKSFLNYYADLETSARELGQNLGPCQGVGEEKAQPGPGQAPVVIGNGDLLPQKPNKPQSSPEDGQVATVSSSPETKKDHPKTGAKTDCALHRIQNLAPSDEESSWTTLSQDSASPSSPDETDIWSDHSFQTDPDLPPGWKRVNDIAGTYYWHIPTGTTQWERPVSIPADLHGSRKGSLSSVTPSPTPENEKQPWSDFAVLNGGKINSDIWKDLHAATVNPDPSLKEFEGATLRYASLKLRNAPHGDDDDSCSINSDPEAKCFAVRSLGWVEMAEEDLAPGKSSVAVNNCIRQLSYCKNDIRDTVGIWGEGKDMYLSLENDMLSLVDPMDRSVLHSQPIVNIRVWGVGRDNGRERDFAYVARDKDTRILKCHVFRCDTPAKAIATSLHEICSKIMAERKNAKALACSSLQERTNMSLDVPLQVDFPTPKTELVQKFRXQYLGMLPVDRPVGMDTXNSXIENLMTSSSKEDWPSXNXNVADATXTXISEKNEEEVLVEXRXRFXSXXGXGKDVHTXXXXMDTGNQRFEXHXXWXEPNXANXSEAXQAXCMLRYQKCLVARPPSQKVRPPPPPADSVTRRVTTXVKRGVLSLIDTLKQKRPVTETP

SEQ ID NO: 852 - protein, 244 aa, Mus musculus
  SITE (28)..(28): Xaa at position 28 is Met, Ile, Leu, Val, Ala, or Gly
  SITE (47)..(47): Xaa at position 47 is Cys, Ala, Val, Gly, Ser, or Thr
  SITE (50)..(50): Xaa at position 50 is Trp, Tyr, Phe, Met, His, Ile, Leu Val, Ala, or Gly
  SITE (55)..(55): Xaa at position 55 is Cys, Ala, Val, Gly, Ser, or Thr
  SITE (86)..(86): Xaa at position 86 is Cys, Ala, Val, Gly, Ser, or Thr
  SITE (93)..(93): Xaa at position 93 is Ala, Gly, or Pro
  SITE (95)..(95): Xaa at position 95 is Cys, Ala, Val, Gly, Ser, or Thr
  SITE (96)..(96): Xaa at position 96 is Phe, Tyr, Met, His, Ile, Leu, Val Ala, or Gly
  SITE (99)..(99): Xaa at position 99 is Cys, Ala, Val, Gly, Ser, or Thr
  SITE (103)..(103): Xaa at position 103 is Leu, Ala, Val, Gly, or Ile
  SITE (120)..(120): Xaa at position 120 is Val, Ala, Gly, Leu, or Ile
  SITE (123)..(123): Xaa at position 123 is Val, Ala, Gly, Leu, or Ile
  SITE (125)..(125): Xaa at position 125 is Leu, Ala, Val, Gly, or Ile
  SITE (126)..(126): Xaa at position 126 is Cys, Ala, Val, Gly, Ser, or Thr
  SITE (130)..(130): Xaa at position 130 is Cys, Ala, Val, Gly, Ser, or Thr
  SITE (133)..(133): Xaa at position 133 is Trp, Tyr, Phe, Met, His, Ile, Leu Val, Ala, or Gly
  SITE (137)..(137): Xaa at position 137 is Cys, Ala, Val, Gly, Ser, or Thr
  SITE (169)..(169): Xaa at position 169 is Phe, Tyr, Met, His, Ile, Leu, Val Ala, or Gly
  SITE (173)..(173): Xaa at position 173 is Phe, Tyr, Met, His, Ile, Leu, Val Ala, or Gly
  SITE (179)..(179): Xaa at position 179 is Leu, Ala, Val, Gly, or Ile
  SITE (180)..(180): Xaa at position 180 is Cys, Ala, Val, Gly, Ser, or Thr
  SITE (183)..(183): Xaa at position 183 is Ile, Ala, Val, Leu, or Gly
  SITE (188)..(188): Xaa at position 188 is Phe, Tyr, Met, His, Ile, Leu, Val Ala, or Gly
  SITE (200)..(200): Xaa at position 200 is Cys, Ala, Val, Gly, Ser, or Thr
  SITE (201)..(201): Xaa at position 201 is Leu, Ala, Val, Gly, or Ile
  SITE (216)..(216): Xaa at position 216 is Val, Ala, Gly, Leu, or Ile
MAQWWQILLGLWAVLPTLAGDKLLSVCXNSKRHKQEPGPEDELYQEXRPXEDNAXCTRSTSWEAHLEEPLLFNFSMMHCGLLTPAXRKHFIQXIXXHEXSPNXGPWIQPVVPNGQEEQRXWGXPXXQEDXEDXWRAXHSSLTCKSNWLHGWDWSEEKKHCPAHEPCLPXSYHXPTPDDXXEKXWNNTXKASPERRNSGRXXQKWFEPTLSNPNVEXALHFAGSALAPQLSYTLPAFSLCLLFHP

SEQ ID NO: 853 - protein, 251 aa, Homo sapiens
  SITE (41)..(41): Xaa at position 41 is His, Phe, Tyr, Lys, Arg, Gly, Ser Thr, Ala, Val, Leu, Ile, Asn, Met, or Gln
  SITE (42)..(42): Xaa at position 42 is Leu, Ala, Val, Gly, or Ile
  SITE (53)..(53): Xaa at position 53 is Leu, Ala, Val, Gly, or Ile
  SITE (55)..(55): Xaa at position 55 is Ile, Ala, Val, Leu, or Gly
  SITE (72)..(72): Xaa at position 72 is Ala, Gly, or Pro
  SITE (73)..(73): Xaa at position 73 is Leu, Ala, Val, Gly, or Ile
  SITE (85)..(85): Xaa at position 85 is Ile, Ala, Val, Leu, or Gly
  SITE (94)..(94): Xaa at position 94 is Leu, Ala, Val, Gly, or Ile
  SITE (95)..(95): Xaa at position 95 is Cys, Ala, Val, Gly, Ser, or Thr
  SITE (96)..(96): Xaa at position 96 is Met, Ile, Leu, Val, Ala, or Gly
  SITE (113)..(113): Xaa at position 113 is Cys, Ala, Val, Gly, Ser, or Thr
  SITE (115)..(115): Xaa at position 115 is Phe, Tyr, Met, His, Ile, Leu, Val Ala, or Gly
  SITE (126)..(126): Xaa at position 126 is Val, Ala, Gly, Leu, or Ile
  SITE (135)..(135): Xaa at position 135 is Leu, Ala, Val, Gly, or Ile
  SITE (136)..(136): Xaa at position 136 is Val, Ala, Gly, Leu, or Ile
  SITE (157)..(157): Xaa at position 157 is Phe, Tyr, Met, His, Ile, Leu, Val Ala, or Gly
MLGARLRLWVCALCSVCSMSVLRAYPNASPLLGSSWGGLIXXYTATARNSYHXQXHKNGHVDGAPHQTIYSXXMIRSEDAGFVVXTGVMSRRYXXXDFRGNIFGSHYFDPENXRXQHQTLENGYDXYHSPQYHFXXSLGRAKRAFLPGMNPPPYSQXLSRRNEIPLIHFNTPIPRRHTRSAEDDSERDPLNVLKPRARMTPAPASCSQELPSAEDNSPMASDPLGVVRGGRVNTHAGGTGPEGCRPFAKFI

SEQ ID NO: 854 - protein, 186 aa, Homo sapiens
  SITE (20)..(20): Xaa at position 20 is Val, Ala, Gly, Leu, or Ile
  SITE (21)..(21): Xaa at position 21 is Leu, Ala, Val, Gly, or Ile
  SITE (22)..(22): Xaa at position 22 is Cys, Ala, Val, Gly, Ser, or Thr
  SITE (23)..(23): Xaa at position 23 is Leu, Ala, Val, Gly, or Ile
  SITE (33)..(33): Xaa at position 33 is Ile, Ala, Val, Leu, or Gly
  SITE (34)..(34): Xaa at position 34 is Ile, Ala, Val, Leu, or Gly
  SITE (58)..(58): Xaa at position 58 is Phe, Tyr, Met, His, Ile, Leu, Val Ala, or Gly
  SITE (70)..(70): Xaa at position 70 is Met, Ile, Leu, Val, Ala, or Gly
  SITE (89)..(89): Xaa at position 89 is Ala, Gly, or Pro
  SITE (90)..(90): Xaa at position 90 is Ile, Ala, Val, Leu, or Gly
  SITE (92)..(92): Xaa at position 92 is Phe, Tyr, Met, His, Ile, Leu, Val Ala, or Gly
  SITE (93)..(93): Xaa at position 93 is Val, Ala, Gly, Leu, or Ile
  SITE (94)..(94): Xaa at position 94 is Ile, Ala, Val, Leu, or Gly
  SITE (104)..(104): Xaa at position 104 is Val, Ala, Gly, Leu, or Ile
  SITE (109)..(109): Xaa at position 109 is Leu, Ala, Val, Gly, or Ile
  SITE (112)..(112): Xaa at position 112 is Leu, Ala, Val, Gly, or Ile
  SITE (118)..(118): Xaa at position 118 is Ile, Ala, Val, Leu, or Gly
  SITE (125)..(125): Xaa at position 125 is Ile, Ala, Val, Leu, or Gly
  SITE (126)..(126): Xaa at position 126 is Leu, Ala, Val, Gly, or Ile
  SITE (127)..(127): Xaa at position 127 is Phe, Tyr, Met, His, Ile, Leu, Val Ala, or Gly
  SITE (128)..(128): Xaa at position 128 is Phe, Tyr, Met, His, Ile, Leu, Val Ala, or Gly
  SITE (129)..(129): Xaa at position 129 is Ala, Gly, or Pro
  SITE (143)..(143): Xaa at position 143 is Val, Ala, Gly, Leu, or Ile
  SITE (149)..(149): Xaa at position 149 is Leu, Ala, Val, Gly, or Ile
  SITE (160)..(160): Xaa at position 160 is Cys, Ala, Val, Gly, Ser, or Thr
MGLLDRLSVLLGLKKKEVHXXXXGLDNSGKTTXXNKLKPSNAQSQNILPTIGFSIEKXKSSSLSFTVFDXSGQGRYRNLWEHYYKEGQXXIXXXDSSDRLRMVXAKEEXDTXLNHPDXKHRRIPXXXXXNKMDLRDAVTSVKXSQLLCXENIKDKPWHIXASDAIKGEGLQEGVDWLQDQIQTVKT

SEQ ID NO: 855 - protein, 335 aa, Homo sapiens
  SITE (44)..(44): Xaa at position 44 is Leu, Ala, Val, Gly, or Ile
  SITE (54)..(54): Xaa at position 54 is Ile, Ala, Val, Leu, or Gly
  SITE (56)..(56): Xaa at position 56 is Met, Ile, Leu, Val, Ala, or Gly
  SITE (64)..(64): Xaa at position 64 is Leu, Ala, Val, Gly, or Ile
  SITE (65)..(65): Xaa at position 65 is Val, Ala, Gly, Leu, or Ile
  SITE (72)..(72): Xaa at position 72 is Tyr, Phe, Met, His, Ile, Leu, Val Ala, or Gly
  SITE (74)..(74): Xaa at position 74 is Val, Ala, Gly, Leu, or Ile
  SITE (75)..(75): Xaa at position 75 is Ile, Ala, Val, Leu, or Gly
  SITE (76)..(76): Xaa at position 76 is Val, Ala, Gly, Leu, or Ile
  SITE (77)..(77): Xaa at position 77 is Met, Ile, Leu, Val, Ala, or Gly
  SITE (78)..(78): Xaa at position 78 is Phe, Tyr, Met, His, Ile, Leu, Val Ala, or Gly
  SITE (90)..(90): Xaa at position 90 is Cys, Ala, Val, Gly, Ser, or Thr
  SITE (93)..(93): Xaa at position 93 is Ala, Gly, or Pro
  SITE (97)..(97): Xaa at position 97 is Phe, Tyr, Met, His, Ile, Leu, Val Ala, or Gly
  SITE (100)..(100): Xaa at position 100 is Leu, Ala, Val, Gly, or Ile
  SITE (101)..(101): Xaa at position 101 is Ala, Gly, or Pro
  SITE (114)..(114): Xaa at position 114 is Ile, Ala, Val, Leu, or Gly
  SITE (116)..(116): Xaa at position 116 is Phe, Tyr, Met, His, Ile, Leu, Val Ala, or Gly
  SITE (119)..(119): Xaa at position 119 is Val, Ala, Gly, Leu, or Ile
  SITE (127)..(127): Xaa at position 127 is Val, Ala, Gly, Leu, or Ile
  SITE (128)..(128): Xaa at position 128 is Phe, Tyr, Met, His, Ile, Leu, Val Ala, or Gly
  SITE (139)..(139): Xaa at position 139 is Phe, Tyr, Met, His, Ile, Leu, Val Ala, or Gly
  SITE (163)..(163): Xaa at position 163 is Ala, Gly, or Pro
  SITE (166)..(166): Xaa at position 166 is Ile, Ala, Val, Leu, or Gly
  SITE (170)..(170): Xaa at position 170 is Ile, Ala, Val, Leu, or Gly
MAARWRFWCVSVTMVVALLIVCDVPSASAQRKKEMVLSEKVSQXMEWTNKRPVXRXNGDKFRRXXKAPPRNXSXXXXXTALQLHRQCVVXKQXDEEXQIXXNSWRYSSAFTNRXFXAMXDFDEGSDXXQMLNMNSAPTXINFPAKGKPKRGDTYELQVRGFSXEQXARWXADRTDVNIRVIRPPNYAGPLMLGLLLAVIGGLVYLRRSNMEFLFNKTGWAFAALCFVLAMTSGQMWNHIRGPPYAHKNPHTGHVNYIHGSSQAQFVAETHIVLLFNGGVTLGMVLLCEAATSDMDIGKRKIMCVAGIGLVVLFFSWMLSIFRSKYHGYPYSFLMS

SEQ ID NO: 856 - protein, 673 aa, Homo sapiens
  SITE (195)..(195): Xaa at position 195 is Leu, Ala, Val, Gly, or Ile
  SITE (234)..(234): Xaa at position 234 is Leu, Ala, Val, Gly, or Ile
  SITE (264)..(264): Xaa at position 264 is Leu, Ala, Val, Gly, or Ile
  SITE (422)..(422): Xaa at position 422 is Ala, Gly, or Pro
  SITE (546)..(546): Xaa at position 546 is Ala, Gly, or Pro
  SITE (548)..(548): Xaa at position 548 is Ala, Gly, or Pro
  SITE (549)..(549): Xaa at position 549 is Ala, Gly, or Pro
MAGKAAEERGLPKGATPQDTSGLQDRLFSSESDNSLYFTYSGQPNTLEVRDLNYQVDLASQVPWFEQLAQFKMPWTSPSCQNSCELGIQNLSFKVRSGQMLAIIGSSGCGRASLLDVITGRGHGGKIKSGQIWINGQPSSPQLVRKCVAHVRQHNQLLPNLTVRETLAFIAQMRLPRTFSQAQRDKRVEDVIAEXRLRQCADTRVGNMYVRGLSGGERRRVSIGVQLLWNPGIXILDEPTSGLDSFTAHNLVKTLSRLAKGNRXVLISLHQPRSDIFRLFDLVLLMTSGTPIYLGAAQHMVQYFTAIGYPCPRYSNPADFYVDLTSIDRRSREQELATREKAQSLAALFLEKVRDLDDFLWKAETKDLDEDTCVESSVTPLDTNCLPSPTKMPGAVQQFTTLIRRQISNDFRDLPTLLIHGXEACLMSMTIGFLYFGHGSIQLSFMDTAALLFMIGALIPFNVILDVISKCYSERAMLYYELEDGLYTTGPYFFAKILGELPEHCAYIIIYGMPTYWLANLRPGLQPFLLHFLLVWLVVFCCRIMXLXXAALLPTFHMASFFSNALYNSFYLAGGFMINLSSLWTVPAWISKVSFLRWCFEGLMKIQFSRRTYKMPLGNLTIAVSGDKILSVMELDSYPLYAIYLIVIGLSGGFMVLYYVSLRFIKQKPSQDW

SEQ ID NO: 857 - protein, 651 aa, Homo sapiens
  SITE (72)..(72): Xaa at position 72 is Val, Ala, Gly, Leu, or Ile
  SITE (81)..(81): Xaa at position 81 is Ile, Ala, Val, Leu, or Gly
  SITE (82)..(82): Xaa at position 82 is Met, Ile, Leu, Val, Ala, or Gly
  SITE (83)..(83): Xaa at position 83 is Cys, Ala, Val, Gly, Ser, or Thr
  SITE (84)..(84): Xaa at position 84 is Ile, Ala, Val, Leu, or Gly
  SITE (85)..(85): Xaa at position 85 is Leu, Ala, Val, Gly, or Ile
  SITE (95)..(95): Xaa at position 95 is Leu, Ala, Val, Gly, or Ile
  SITE (96)..(96): Xaa at position 96 is Leu, Ala, Val, Gly, or Ile
  SITE (139)..(139): Xaa at position 139 is Leu, Ala, Val, Gly, or Ile
  SITE (142)..(142): Xaa at position 142 is Leu, Ala, Val, Gly, or Ile
  SITE (144)..(144): Xaa at position 144 is Val, Ala, Gly, Leu, or Ile
  SITE (148)..(148): Xaa at position 148 is Leu, Ala, Val, Gly, or Ile
  SITE (150)..(150): Xaa at position 150 is Tyr, Phe, Met, His, Ile, Leu, Val Ala, or Gly
  SITE (155)..(155): Xaa at position 155 is Ala, Gly, or Pro
  SITE (168)..(168): Xaa at position 168 is Val, Ala, Gly, Leu, or Ile
  SITE (172)..(172): Xaa at position 172 is Met, Ile, Leu, Val, Ala, or Gly
  SITE (185)..(185): Xaa at position 185 is Ile, Ala, Val, Leu, or Gly
  SITE (204)..(204): Xaa at position 204 is Ala, Gly, or Pro
  SITE (214)..(214): Xaa at position 214 is Met, Ile, Leu, Val, Ala, or Gly
  SITE (215)..(215): Xaa at position 215 is Leu, Ala, Val, Gly, or Ile
  SITE (216)..(216): Xaa at position 216 is Phe, Tyr, Met, His, Ile, Leu, Val Ala, or Gly
  SITE (235)..(235): Xaa at position 235 is Leu, Ala, Val, Gly, or Ile
  SITE (239)..(239): Xaa at position 239 is Ala, Gly, or Pro
  SITE (244)..(244): Xaa at position 244 is Ile, Ala, Val, Leu, or Gly
  SITE (245)..(245): Xaa at position 245 is Val, Ala, Gly, Leu, or Ile
  SITE (249)..(249): Xaa at position 249 is Ile, Ala, Val, Leu, or Gly
  SITE (263)..(263): Xaa at position 263 is Ile, Ala, Val, Leu, or Gly
  SITE (264)..(264): Xaa at position 264 is Ala, Gly, or Pro
  SITE (273)..(273): Xaa at position 273 is Phe, Tyr, Met, His, Ile, Leu, Val Ala, or Gly
  SITE (280)..(280): Xaa at position 280 is Met, Ile, Leu, Val, Ala, or Gly
  SITE (284)..(284): Xaa at position 284 is Phe, Tyr, Met, His, Ile, Leu, Val Ala, or Gly
  SITE (298)..(298): Xaa at position 298 is Phe, Tyr, Met, His, Ile, Leu, Val Ala, or Gly
  SITE (301)..(301): Xaa at position 301 is Tyr, Phe, Met, His, Ile, Leu, Val Ala, or Gly
  SITE (329)..(329): Xaa at position 329 is Tyr, Phe, Met, His, Ile, Leu, Val Ala, or Gly
  SITE (371)..(371): Xaa at position 371 is Leu, Ala, Val, Gly, or Ile
  SITE (375)..(375): Xaa at position 375 is Val, Ala, Gly, Leu, or Ile
  SITE (415)..(415): Xaa at position 415 is Ala, Gly, or Pro
  SITE (423)..(423): Xaa at position 423 is Leu, Ala, Val, Gly, or Ile
  SITE (426)..(426): Xaa at position 426 is Phe, Tyr, Met, His, Ile, Leu, Val Ala, or Gly
  SITE (427)..(427): Xaa at position 427 is Val, Ala, Gly, Leu, or Ile
  SITE (435)..(435): Xaa at position 435 is Met, Ile, Leu, Val, Ala, or Gly
  SITE (438)..(438): Xaa at position 438 is Ala, Gly, or Pro
  SITE (442)..(442): Xaa at position 442 is Phe, Tyr, Met, His, Ile, Leu, Val Ala, or Gly
  SITE (448)..(448): Xaa at position 448 is Val, Ala, Gly, Leu, or Ile
  SITE (458)..(458): Xaa at position 458 is Tyr, Phe, Met, His, Ile, Leu, Val Ala, or Gly
  SITE (463)..(463): Xaa at position 463 is Met, Ile, Leu, Val, Ala, or Gly
  SITE (464)..(464): Xaa at position 464 is Met, Ile, Leu, Val, Ala, or Gly
  SITE (466)..(466): Xaa at position 466 is Ala, Gly, or Pro
  SITE (467)..(467): Xaa at position 467 is Tyr, Phe, Met, His, Ile, Leu, Val Ala, or Gly
  SITE (471)..(471): Xaa at position 471 is Val, Ala, Gly, Leu, or Ile
  SITE (478)..(478): Xaa at position 478 is Ala, Gly, or Pro
  SITE (482)..(482): Xaa at position 482 is Phe, Tyr, Met, His, Ile, Leu, Val Ala, or Gly
  SITE (486)..(486): Xaa at position 486 is Cys, Ala, Val, Gly, Ser, or Thr
  SITE (487)..(487): Xaa at position 487 is Tyr, Phe, Met, His, Ile, Leu, Val Ala, or Gly
  SITE (490)..(490): Xaa at position 490 is Leu, Ala, Val, Gly, or Ile
  SITE (492)..(492): Xaa at position 492 is Leu, Ala, Val, Gly, or Ile
  SITE (505)..(505): Xaa at position 505 is Ala, Gly, or Pro
  SITE (506)..(506): Xaa at position 506 is Leu, Ala, Val, Gly, or Ile
  SITE (508)..(508): Xaa at position 508 is Ala, Gly, or Pro
  SITE (510)..(510): Xaa at position 510 is His, Phe, Tyr, Lys, Arg, Gly, Ser Thr, Ala, Val, Leu, Ile, Asn, Met, or Gln
  SITE (511)..(511): Xaa at position 511 is Leu, Ala, Val, Gly, or Ile
  SITE (518)..(518): Xaa at position 518 is Leu, Ala, Val, Gly, or Ile
  SITE (521)..(521): Xaa at position 521 is Leu, Ala, Val, Gly, or Ile
  SITE (530)..(530): Xaa at position 530 is Val, Ala, Gly, Leu, or Ile
  SITE (534)..(534): Xaa at position 534 is Val, Ala, Gly, Leu, or Ile
  SITE (571)..(571): Xaa at position 571 is Cys, Ala, Val, Gly, Ser, or Thr
  SITE (574)..(574): Xaa at position 574 is Ile, Ala, Val, Leu, or Gly
  SITE (575)..(575): Xaa at position 575 is Leu, Ala, Val, Gly, or Ile
  SITE (576)..(576): Xaa at position 576 is Val, Ala, Gly, Leu, or Ile
  SITE (580)..(580): Xaa at position 580 is Phe, Tyr, Met, His, Ile, Leu, Val Ala, or Gly
  SITE (613)..(613): Xaa at position 613 is Cys, Ala, Val, Gly, Ser, or Thr
  SITE (616)..(616): Xaa at position 616 is Ala, Gly, or Pro
  SITE (627)..(627): Xaa at position 627 is Leu, Ala, Val, Gly, or Ile
  SITE (642)..(642): Xaa at position 642 is Phe, Tyr, Met, His, Ile, Leu, Val Ala, or Gly
MGDLSSLTPGGSMGLQVNRGSQSSLEGAPATAPEPHSLGILHASYSVSHRVRPWWDITSCRQQWTRQILKDXSLYVESGQXXXXXGSSGSGKTTXXDAMSGRLGRAGTFLGEVYVNGRALRREQFQDCFSYVLQSDTLXSSXTXRETXHXTALLXIRRGNPGSFQKKXEAVXAELSLSHVADRLXGNYSLGGISTGERRRVSIXAQLLQDPKVXXXDEPTTGLDCMTANQIVVLXVELXRRNRXXVLTXHQPRSELFQLFDKXXILSFGELIXCGTPAEXLDFXNDCGYPCPEHSNPXDFXMDLTSVDTQSKEREIETSKRVQMIESAXKKSAICHKTLKNIERMKHLKTLPMVPFKTKDSPGVFSKLGVXLRRXTRNLVRNKLAVITRLLQNLIMGLFLLFFVLRVRSNVLKGXIQDRVGLXYQXXGATPYTGXLNXVNLXPVLRAXSDQESQDGLXQKWQXXLXXALHXLPFSVVXTMIXSSVXXWTXGXHPEVARFGYFSAXXLXPXXIGEFLTXVLXGIVQNPNIXNSVXALLSIAGVLVGSGFLRNIQEMPIPFKIISYFTFQKYXSEXXXVNEXYGLNFTCGSSNVSVTTNPMCAFTQGIQFIEKTXPGXTSRFTMNFLIXYSFIPALVILGIVVXKIRDHLISR

SEQ ID NO: 858 - protein, 3354 aa, Homo sapiens
  SITE (42)..(42): Xaa at position 42 is Ile, Ala, Val, Leu, or Gly
  SITE (55)..(55): Xaa at position 55 is Leu, Ala, Val, Gly, or Ile
  SITE (78)..(78): Xaa at position 78 is Phe, Tyr, Met, His, Ile, Leu, Val Ala, or Gly
  SITE (87)..(87): Xaa at position 87 is Val, Ala, Gly, Leu, or Ile
  SITE (89)..(89): Xaa at position 89 is Leu, Ala, Val, Gly, or Ile
  SITE (103)..(103): Xaa at position 103 is Val, Ala, Gly, Leu, or Ile
  SITE (105)..(105): Xaa at position 105 is Phe, Tyr, Met, His, Ile, Leu, Val Ala, or Gly
  SITE (107)..(107): Xaa at position 107 is Val, Ala, Gly, Leu, or Ile
  SITE (118)..(118): Xaa at position 118 is Val, Ala, Gly, Leu, or Ile
  SITE (120)..(120): Xaa at position 120 is Ile, Ala, Val, Leu, or Gly
  SITE (122)..(122): Xaa at position 122 is Val, Ala, Gly, Leu, or Ile
  SITE (154)..(154): Xaa at position 154 is Val, Ala, Gly, Leu, or Ile
  SITE (187)..(187): Xaa at position 187 is Val, Ala, Gly, Leu, or Ile
  SITE (189)..(189): Xaa at position 189 is Val, Ala, Gly, Leu, or Ile
  SITE (205)..(205): Xaa at position 205 is Val, Ala, Gly, Leu, or Ile
  SITE (207)..(207): Xaa at position 207 is Ala, Gly, or Pro
  SITE (222)..(222): Xaa at position 222 is Leu, Ala, Val, Gly, or Ile
  SITE (224)..(224): Xaa at position 224 is Ile, Ala, Val, Leu, or Gly
MGRHVATSCHVAWLLVLISGCWGQVNRLPFFTNHFFDTYLLXSEDTPVGSSVTQXLAQDMDNDPLVFGVSGEEASRFXAVEPDTGVXWXRQPLDRETKSEFTXEXSXSDHQGVITRKXNXQXGDVNDNAPTFHNQPYSVRIPENTPVGTPIFIXNATDPDLGAGGSVLYSFQPPSQFFAIDSARGIXTXIRELDYETTQAYQLTXNXTDQDKTRPLSTLANXAXIITDVQDMDPIFINLPYSTNIYEHSPPGTTVRIITAIDQDKGRPRGIGYTIVSGNTNSIFALDYISGVLTLNGLLDRENPLYSHGFILTVKGTELNDDRTPSDATVTTTFNILVIDINDNAPEFNSSEYSVAITELAQVGFALPLFIQVVDKDENLGLNSMFEVYLVGNNSHHFIISPTSVQGKADIRIRVAIPLDYETVDRYDFDLFANESVPDHVGYAKVKITLINENDNRPIFSQPLYNISLYENVTVGTSVLTVLATDNDAGTFGEVSYFFSDDPDRFSLDKDTGLIMLIARLDYELIQRFTLTIIARDGGGEETTGRVRINVLDVNDNVPTFQKDAYVGALRENEPSVTQLVRLRATDEDSPPNNQITYSIVSASAFGSYFDISLYEGYGVISVSRPLDYEQISNGLIYLTVMAMDAGNPPLNSTVPVTIEVFDENDNPPTFSKPAYFVSVVENIMAGATVLFLNATDLDRSREYGQESIIYSLEGSTQFRINARSGEITTTSLLDRETKSEYILIVRAVDGGVGHNQKTGIATVNITLLDINDNHPTWKDAPYYINLVEMTPPDSDVTTVVAVDPDLGENGTLVYSIQPPNKFYSLNSTTGKIRTTHAMLDRENPDPHEAELMRKIVVSVTDCGRPPLKATSSATVFVNLLDLNDNDPTFQNLPFVAEVLEGIPAGVSIYQVVAIDLDEGLNGLVSYRMPVGMPRMDFLINSSSGVVVTTTELDRERIAEYQLRVVASDAGTPTKSSTSTLTIHVLDVNDETPTFFPAVYNVSVSEDVPREFRVVWLNCTDNDVGLNAELSYFITGGNVDGKFSVGYRDAVVRTVVGLDRETTAAYMLILEAIDNGPVGKRHTGTATVFVTVLDVNDNRPIFLQSSYEASVPEDIPEGHSILQLKATDADEGEFGRVWYRILHGNHGNNFRIHVSNGLLMRGPRPLDRERNSSHVLIVEAYNHDLGPMRSSVRVIVYVEDINDEAPVFTQQQYSRLGLRETAGIGTSVIVVQATDRDSGDGGLVNYRILSGAEGKFEIDESTGLIITVNYLDYETKTSYMMNVSATDQAPPFNQGFCSVYITLLNELDEAVQFSNASYEAAILENLALGTEIVRVQAYSIDNLNQITYRFNAYTSTQAKALFKIDAITGVITVQGLVDREKGDFYTLTVVADDGGPKVDSTVKVYITVLDENDNSPRFDFTSDSAVSIPEDCPVGQRVATVKAWDPDAGSNGQVVFSLASGNIAGAFEIVTTNDSIGEVFVARPLDREELDHYILQVVASDRGTPPRKKDHILQVTILDINDNPPVIESPFGYNVSVNENVGGGTAVVQVRATDRDIGINSVLSYYITEGNKDMAFRMDRISGEIATRPAPPDRERQSFYHLVATVEDEGTPTLSATTHVYVTIVDENDNAPMFQQPHYEVLLDEGPDTLNTSLITIQALDLDEGPNGTVTYAIVAGNIVNTFRIDRHMGVITAAKELDYEISHGRYTLIVTATDQCPILSHRLTSTTTVLVNVNDINDNVPTFPRDYEGPFEVTEGQPGPRVWTFLAHDRDSGPNGQVEYSIMDGDPLGEFVISPVEGVLRVRKDVELDRETIAFYNLTICARDRGMPPLSSTMLVGIRVLDINDNDPVLLNLPMNITISENSPVSSFVAHVLASDADSGCNARLTFNITAGNRERAFFINATTGIVTVNRPLDRERIPEYKLTISVKDNPENPRIARRDYDLLLIFLSDENDNHPLFTKSTYQAEVMENSPAGTPLTVLNGPILALDADQDIYAVVTYQLLGAQSGLFDINSSTGVVTVRSGVIIDREAFSPPILELLLLAEDIGLLNSTAHLLITILDDNDNRPTFSPATLTVHLLENCPPGFSVLQVTATDEDSGLNGELVYRIEAGAQDRFLIHLVTGVIRVGNATIDREEQESYRLTVVATDRGTVPLSGTAIVTILIDDINDSRPEFLNPIQTVSVLESAEPGTVIANITAIDHDLNPKLEYHIVGIVAKDDTDRLVPNQEDAFAVNINTGSVMVKSPMNRELVATYEVTLSVIDNASDLPERSVSVPNAKLTVNVLDVNDNTPQFKPFGITYYMERILEGATPGTTLIAVAAVDPDKGLNGLVTYTLLDLVPPGYVQLEDSSAGKVIANRTVDYEEVHWLNFTVRASDNGSPPRAAEIPVYLEIVDINDNNPIFDQPSYQEAVFEDVPVGTIILTVTATDADSGNFALIEYSLGDGESKFAINPTTGDIYVLSSLDREKKDHYILTALAKDNPGDVASNRRENSVQVVIQVLDVNDCRPQFSKPQFSTSVYENEPAGTSVITMMATDQDEGPNGELTYSLEGPGVEAFHVDMDSGLVTTQRPLQSYEKFSLTVVATDGGEPPLWGTTMLLVEVIDVNDNRPVFVRPPNGTILHIREEIPLRSNVYEVYATDKDEGLNGAVRYSFLKTAGNRDWEFFIIDPISGLIQTAQRLDRESQAVYSLILVASDLGQPVPYETMQPLQVALEDIDDNEPLFVRPPKGSPQYQLLTVPEHSPRGTLVGNVTGAVDADEGPNAIVYYFIAAGNEEKNFHLQPDGCLLVLRDLDREREAIFSFIVKASSNRSWTPPRGPSPTLDLVADLTLQEVRVVLEDINDQPPRFTKAEYTAGVATDAKVGSELIQVLALDADIGNNSLVFYSILAIHYFRALANDSEDVGQVFTMGSMDGILRTFDLFMAYSPGYFVVDIVARDLAGHNDTAIIGIYILRDDQRVKIVINEIPDRVRGFEEEFIHLLSNITGAIVNTDNVQFHVDKKGRVNFAQTELLIHVVNRDTNRILDVDRVIQMIDENKEQLRNLFRNYNVLDVQPAISVRLPDDMSALQMAIIVLAILLFLAAMLFVLMNWYYRTVHKRKLKAIVAGSAGNRGFIDIMDMPNTNKYSFDGANPVWLDPFCRNLELAAQAEHEDDLPENLSEIADLWNSPTRTHGTFGREPAAVKPDDDRYLRAAIQEYDNIAKLGQIIREGPIKGSLLKVVLEDYLRLKKLFAQRMVQKASSCHSSISELIQTELDEEPGDHSPGQGSLRFRHKPPVELKGPDGIHVVHGSTGTLLATDLNSLPEEDQKGLGRSLETLTAAEATAFERNARTESAKSTPLHKLRDVIMETPLEITEL

SEQ ID NO: 859 - protein, 198 aa, Homo sapiens
  SITE (16)..(16): Xaa at position 16 is Leu, Ala, Val, Gly, or Ile
  SITE (17)..(17): Xaa at position 17 is Tyr, Phe, Met, His, Ile, Leu, Val Ala, or Gly
  SITE (20)..(20): Xaa at position 20 is Leu, Ala, Val, Gly, or Ile
  SITE (31)..(31): Xaa at position 31 is Ile, Ala, Val, Leu, or Gly
  SITE (53)..(53): Xaa at position 53 is Ala, Gly, or Pro
  SITE (60)..(60): Xaa at position 60 is Ile, Ala, Val, Leu, or Gly
  SITE (63)..(63): Xaa at position 63 is Ala, Gly, or Pro
  SITE (67)..(67): Xaa at position 67 is Leu, Ala, Val, Gly, or Ile
  SITE (75)..(75): Xaa at position 75 is Ile, Ala, Val, Leu, or Gly
  SITE (95)..(95): Xaa at position 95 is Val, Ala, Gly, Leu, or Ile
MADQRQRSLSTSGESXXHVXGLDKNATSDDXKKSYRKLALKYHPDKNPDNPEXADKFKEXNNXHAIXTDATKRNXYDKYGSLGLYVAEQFGEENXNTYFVLSSWWAKALFVFCGLLTCCYCCCCLCCCFNCCCGKCKPKAPEGEETEFYVSPEDLEAQLQSDEREATDTPIVIQPASATETTQLTADSHPSYHTDGFN

SEQ ID NO: 860 - protein, 434 aa, Homo sapiens
  SITE (416)..(416): Xaa at position 416 is Ile, Ala, Val, Leu, or Gly
MLPARCARLLTPHLLLVLVQLSPARGHRTTGPRFLISDRDPQCNLHCSRTQPKPICASDGRSYESMCEYQRAKCRDPTLGVVHRGRCKDAGQSKCRLERAQALEQAKKPQEAVFVPECGEDGSFTQVQCHTYTGYCWCVTPDGKPISGSSVQNKTPVCSGSVTDKPLSQGNSGRKDDGSKPTPTMETQPVFDGDEITAPTLWIKHLVIKDSKLNNTNIRNSEKVYSCDQERQSALEEAQQNPREGIVIPECAPGGLYKPVQCHQSTGYCWCVLVDTGRPLPGTSTRYVMPSCESDARAKTTEADDPFKDRELPGCPEGKKMEFITSLLDALTTDMVQAINSAAPTGGGRFSEPDPSHTLEERVVHWYFSQLDSNSSNDINKREMKPFKRYVKKKAKPKKCARRFTDYCDLNKDKVXSLPELKGCLGVSKEGRLV

SEQ ID NO: 861 - protein, 564 aa, Homo sapiens
  SITE (45)..(45): Xaa at position 45 is Leu, Ala, Val, Gly, or Ile
  SITE (46)..(46): Xaa at position 46 is Tyr, Phe, Met, His, Ile, Leu, Val Ala, or Gly
  SITE (47)..(47): Xaa at position 47 is Phe, Tyr, Met, His, Ile, Leu, Val Ala, or Gly
  SITE (48)..(48): Xaa at position 48 is Ile, Ala, Val, Leu, or Gly
  SITE (49)..(49): Xaa at position 49 is Leu, Ala, Val, Gly, or Ile
  SITE (55)..(55): Xaa at position 55 is Val, Ala, Gly, Leu, or Ile
  SITE (62)..(62): Xaa at position 62 is Ile, Ala, Val, Leu, or Gly
  SITE (63)..(63): Xaa at position 63 is Tyr, Phe, Met, His, Ile, Leu, Val Ala, or Gly
  SITE (65)..(65): Xaa at position 65 is Phe, Tyr, Met, His, Ile, Leu, Val Ala, or Gly
  SITE (66)..(66): Xaa at position 66 is Val, Ala, Gly, Leu, or Ile
  SITE (69)..(69): Xaa at position 69 is Leu, Ala, Val, Gly, or Ile
  SITE (78)..(78): Xaa at position 78 is Leu, Ala, Val, Gly, or Ile
  SITE (80)..(80): Xaa at position 80 is Met, Ile, Leu, Val, Ala, or Gly
  SITE (82)..(82): Xaa at position 82 is Phe, Tyr, Met, His, Ile, Leu, Val Ala, or Gly
  SITE (83)..(83): Xaa at position 83 is Ile, Ala, Val, Leu, or Gly
  SITE (84)..(84): Xaa at position 84 is Val, Ala, Gly, Leu, or Ile
  SITE (85)..(85): Xaa at position 85 is Phe, Tyr, Met, His, Ile, Leu, Val Ala, or Gly
  SITE (109)..(109): Xaa at position 109 is Leu, Ala, Val, Gly, or Ile
  SITE (113)..(113): Xaa at position 113 is Leu, Ala, Val, Gly, or Ile
  SITE (120)..(120): Xaa at position 120 is Met, Ile, Leu, Val, Ala, or Gly
  SITE (124)..(124): Xaa at position 124 is Phe, Tyr, Met, His, Ile, Leu, Val Ala, or Gly
  SITE (127)..(127): Xaa at position 127 is Ala, Gly, or Pro
  SITE (131)..(131): Xaa at position 131 is Ile, Ala, Val, Leu, or Gly
  SITE (145)..(145): Xaa at position 145 is Ile, Ala, Val, Leu, or Gly
  SITE (146)..(146): Xaa at position 146 is Ile, Ala, Val, Leu, or Gly
  SITE (147)..(147): Xaa at position 147 is Ala, Gly, or Pro
  SITE (148)..(148): Xaa at position 148 is Leu, Ala, Val, Gly, or Ile
  SITE (159)..(159): Xaa at position 159 is Phe, Tyr, Met, His, Ile, Leu, Val Ala, or Gly
  SITE (165)..(165): Xaa at position 165 is Ala, Gly, or Pro
  SITE (175)..(175): Xaa at position 175 is Val, Ala, Gly, Leu, or Ile
  SITE (177)..(177): Xaa at position 177 is Cys, Ala, Val, Gly, Ser, or Thr
  SITE (178)..(178): Xaa at position 178 is Val, Ala, Gly, Leu, or Ile
  SITE (180)..(180): Xaa at position 180 is Val, Ala, Gly, Leu, or Ile
  SITE (188)..(188): Xaa at position 188 is Leu, Ala, Val, Gly, or Ile
  SITE (191)..(191): Xaa at position 191 is Ile, Ala, Val, Leu, or Gly
  SITE (192)..(192): Xaa at position 192 is Ala, Gly, or Pro
  SITE (208)..(208): Xaa at position 208 is Leu, Ala, Val, Gly, or Ile
MATAERRALGIGFQWLSLATLVLICAGQGGRREDGGPACYGGFDXXXXXDKSGSXLHHWNEXXYXXEQXAHKFISPQXRXSXXXXSTRGTTLMKLTEDREQIRQGLEEXQKVXPGGDTYXHEGXERXSEQXYYENRQGYRTASVXXXXTDGELHEDLFXYSEREXNRSRDLGAIXYXXGXKDFNETQXARXXDSKDHVFPVNDGFQAXQGIIHSILKKSCIEILAAEPSTICAGESFQVVVRGNGFRHARNVDRVLCSFKINDSVTLNEKPFSVEDTYLLCPAPILKEVGMKAALQVSMNDGLSFISSSVIITTTHCSDGSILAIALLILFLLLALALLWWFWPLCCTVIIKEVPPPPAEESEEEDDDGLPKKKWPTVDASYYGGRGVGGIKRMEVRWGEKGSTEEGAKLEKAKNARVKMPEQEYEFPEPRNLNNNMRRPSSPRKWYSPIKGKLDALWVLLRKGYDRVSVMRPQPGDTGRCINFTRVKNNQPAKYPLNNAYHTSSPPPAPIYTPPPPAPHCPPPPPSAPTPPIPSPPSTLPPPPQAPPPNRAPPPSRPPPRPSV

SEQ ID NO: 862 - protein, 404 aa, Homo sapiens
  SITE (14)..(14): Xaa at position 14 is Leu, Ala, Val, Gly, or Ile
  SITE (30)..(30): Xaa at position 30 is Phe, Tyr, Met, His, Ile, Leu, Val Ala, or Gly
  SITE (32)..(32): Xaa at position 32 is Leu, Ala, Val, Gly, or Ile
  SITE (39)..(39): Xaa at position 39 is Phe, Tyr, Met, His, Ile, Leu, Val Ala, or Gly
  SITE (81)..(81): Xaa at position 81 is Phe, Tyr, Met, His, Ile, Leu, Val Ala, or Gly
  SITE (82)..(82): Xaa at position 82 is Val, Ala, Gly, Leu, or Ile
  SITE (83)..(83): Xaa at position 83 is Met, Ile, Leu, Val, Ala, or Gly
  SITE (92)..(92): Xaa at position 92 is Leu, Ala, Val, Gly, or Ile
  SITE (103)..(103): Xaa at position 103 is Trp, Tyr, Phe, Met, His, Ile, Leu Val, Ala, or Gly
  SITE (106)..(106): Xaa at position 106 is Val, Ala, Gly, Leu, or Ile
  SITE (107)..(107): Xaa at position 107 is Leu, Ala, Val, Gly, or Ile
  SITE (198)..(198): Xaa at position 198 is Cys, Ala, Val, Gly, Ser, or Thr
  SITE (215)..(215): Xaa at position 215 is Leu, Ala, Val, Gly, or Ile
  SITE (220)..(220): Xaa at position 220 is Ile, Ala, Val, Leu, or Gly
  SITE (235)..(235): Xaa at position 235 is Ile, Ala, Val, Leu, or Gly
  SITE (246)..(246): Xaa at position 246 is Cys, Ala, Val, Gly, Ser, or Thr
  SITE (257)..(257): Xaa at position 257 is Leu, Ala, Val, Gly, or Ile
  SITE (258)..(258): Xaa at position 258 is Phe, Tyr, Met, His, Ile, Leu, Val Ala, or Gly
  SITE (260)..(260): Xaa at position 260 is Ile, Ala, Val, Leu, or Gly
  SITE (269)..(269): Xaa at position 269 is Val, Ala, Gly, Leu, or Ile
  SITE (284)..(284): Xaa at position 284 is Val, Ala, Gly, Leu, or Ile
MPYVDRQNRICGFXDIEENENSGKFLRRYXIXDTREDSXVWYMDNPQNLPSGSSRVGAIKLTYISKVSDATKLRPKAEFCXXXNAGMRKYFXQANDQQDLVEXVNXXNKAIKITVPKQSDSQPNSDNLSRHGECGKKQVSYRTDIVGGVPIITPTQKEEVNECGESIDRNNLKRSQSHLPYFTPKPPQDSAVIKAGYXVKQGAVMKNWKRRYFQXDENTXGYFKSELEKEPLRVXPLKEVHKVQEXKQSDIMMRDNXXEXVTTSRTFYXQADSPEEMHSWIKAXSGAIVAQRGPGRSASSEHPPGPSESKHAFRPTNAATATSHSTASRSNSLVSTFTMEKRGFYESLAKVKPGNFKVQTVSPREPASKVTEQALLRPQSKNGPQEKDCDLVDLDDASLPVSDV

SEQ ID NO: 863 - protein, 871 aa, Homo sapiens
  SITE (487)..(487): Xaa at position 487 is Leu, Ala, Val, Gly, or Ile
MADSSEGPRAGPGEVAELPGDESGTPGGEAFPLSSLANLFEGEDGSLSPSPADASRPAGPGDGRPNLRMKFQGAFRKGVPNPIDLLESTLYESSVVPGPKKAPMDSLFDYGTYRHHSSDNKRWRKKIIEKQPQSPKAPAPQPPPILKVFNRPILFDIVSRGSTADLDGLLPFLLTHKKRLTDEEFREPSTGKTCLPKALLNLSNGRNDTIPVLLDIAERTGNMREFINSPFRDIYYRGQTALHIAIERRCKHYVELLVAQGADVHAQARGRFFQPKDEGGYFYFGELPLSLAACTNQPHIVNYLTENPHKKADMRRQDSRGNTVLHALVAIADNTRENTKFVTKMYDLLLLKCARLFPDSNLEAVLNNDGLSPLMMAAKTGKIGIFQHIIRREVTDEDTRHLSRKFKDWAYGPVYSSLYDLSSLDTCGEEASVLEILVYNSKIENRHEMLAVEPINELLRDKWRKFGAVSFYINVVSYLCAMVIFTXTAYYQPLEGTPPYPYRTTVDYLRLAGEVITLFTGVLFFFTNIKDLFMKKCPGVNSLFIDGSFQLLYFIYSVLVIVSAALYLAGIEAYLAVMVFALVLGWMNALYFTRGLKLTGTYSIMIQKILFKDLFRFLLVYLLFMIGYASALVSLLNPCANMKVCNEDQTNCTVPTYPSCRDSETFSTFLLDLFKLTIGMGDLEMLSSTKYPVVFIILLVTYIILTFVLLLNMLIALMGETVGQVSKESKHIWKLQWATTILDIERSFPVFLRKAFRSGEMVTVGKSSDGTPDRRWCFRVDEVNWSHWNQNLGIINEDPGKNETYQYYGFSHTVGRLRRDRWSSVVPRVVELNKNSNPDEVVVPLDSMGNPRCDGHQQGYPRKWRTDDAPL

SEQ ID NO: 864 - protein, 155 aa, Homo sapiens
  SITE (35)..(35): Xaa at position 35 is Leu, Ala, Val, Gly, or Ile
  SITE (39)..(39): Xaa at position 39 is Val, Ala, Gly, Leu, or Ile
  SITE (42)..(42): Xaa at position 42 is Leu, Ala, Val, Gly, or Ile
  SITE (56)..(56): Xaa at position 56 is Ala, Gly, or Pro
  SITE (64)..(64): Xaa at position 64 is Cys, Ala, Val, Gly, Ser, or Thr
  SITE (68)..(68): Xaa at position 68 is Ala, Gly, or Pro
  SITE (69)..(69): Xaa at position 69 is Phe, Tyr, Met, His, Ile, Leu, Val Ala, or Gly
  SITE (71)..(71): Xaa at position 71 is Cys, Ala, Val, Gly, Ser, or Thr
  SITE (72)..(72): Xaa at position 72 is Phe, Tyr, Met, His, Ile, Leu, Val Ala, or Gly
  SITE (77)..(77): Xaa at position 77 is Leu, Ala, Val, Gly, or Ile
  SITE (89)..(89): Xaa at position 89 is Ile, Ala, Val, Leu, or Gly
  SITE (96)..(96): Xaa at position 96 is Leu, Ala, Val, Gly, or Ile
  SITE (129)..(129): Xaa at position 129 is Phe, Tyr, Met, His, Ile, Leu, Val Ala, or Gly
  SITE (130)..(130): Xaa at position 130 is Leu, Ala, Val, Gly, or Ile
  SITE (133)..(133): Xaa at position 133 is Phe, Tyr, Met, His, Ile, Leu, Val Ala, or Gly
  SITE (136)..(136): Xaa at position 136 is Leu, Ala, Val, Gly, or Ile
  SITE (137)..(137): Xaa at position 137 is Leu, Ala, Val, Gly, or Ile
  SITE (141)..(141): Xaa at position 141 is Ile, Ala, Val, Leu, or Gly
MERIVICLMVIFLGTLVHKSSSQGQDRHMIRMRQXIDIXDQXKNYVNDLVPEFLPXPEDVETNXEWSXXSXXQKAQXKSANTGNNERIXNVSIKKXKRKPPSTNAGRRQKHRLTCPSCDSYEKKPPKEXXERXKSXXQKMXHQHLSSRTHGSEDS

SEQ ID NO: 865 - protein, 757 aa, Homo sapiens
  SITE (15)..(15): Xaa at position 15 is Ile, Ala, Val, Leu, or Gly
  SITE (17)..(17): Xaa at position 17 is Leu, Ala, Val, Gly, or Ile
  SITE (19)..(19): Xaa at position 19 is Val, Ala, Gly, Leu, or Ile
  SITE (22)..(22): Xaa at position 22 is Ala, Gly, or Pro
  SITE (25)..(25): Xaa at position 25 is Leu, Ala, Val, Gly, or Ile
  SITE (33)..(33): Xaa at position 33 is Leu, Ala, Val, Gly, or Ile
  SITE (38)..(38): Xaa at position 38 is Ala, Gly, or Pro
  SITE (40)..(40): Xaa at position 40 is Ile, Ala, Val, Leu, or Gly
  SITE (42)..(42): Xaa at position 42 is Val, Ala, Gly, Leu, or Ile
  SITE (68)..(68): Xaa at position 68 is Leu, Ala, Val, Gly, or Ile
  SITE (76)..(76): Xaa at position 76 is Ile, Ala, Val, Leu, or Gly
  SITE (78)..(78): Xaa at position 78 is Ile, Ala, Val, Leu, or Gly
  SITE (80)..(80): Xaa at position 80 is Val, Ala, Gly, Leu, or Ile
  SITE (86)..(86): Xaa at position 86 is Ile, Ala, Val, Leu, or Gly
  SITE (94)..(94): Xaa at position 94 is Phe, Tyr, Met, His, Ile, Leu, Val Ala, or Gly
  SITE (133)..(133): Xaa at position 133 is Ile, Ala, Val, Leu, or Gly
  SITE (135)..(135): Xaa at position 135 is Val, Ala, Gly, Leu, or Ile
  SITE (324)..(324): Xaa at position 324 is Phe, Tyr, Met, His, Ile, Leu, Val Ala, or Gly
MSNPGTRRNGSSIKXRXTXLCXKNXAKKDFFRXPDPFXKXVXDGSGQCHSTDTVKNTLDPKWNQHYDXYVGKTDSXTXSXWNHKKXHKKQGAGXLGCVRLLSNAISRLKDTGYQRLDLCKLNPSDTDAVRGQXVXSLQTRDRIGTGGSVVDCRGLLENEGTVYEDSGPGRPLSCFMEEPAPYTDSTGAAAGGGNCRFVESPSQDQRLQAQRLRNPDVRGSLQTPQNRPHGHQSPELPEGYEQRTTVQGQVYFLHTQTGVSTWHDPRIPSPSGTIPGGDAAFLYEFLLQGHTSEPRDLNSVNCDELGPLPPGWEVRSTVSGRIYXVDHNNRTTQFTDPRLHHIMNHQCQLKEPSQPLPLPSEGSLEDEELPAQRYERDLVQKLKVLRHELSLQQPQAGHCRIEVSREEIFEESYRQIMKMRPKDLKKRLMVKFRGEEGLDYGGVAREWLYLLCHEMLNPYYGLFQYSTDNIYMLQINPDSSINPDHLSYFHFVGRIMGLAVFHGHYINGGFTVPFYKQLLGKPIQLSDLESVDPELHKSLVWILENDITPVLDHTFCVEHNAFGRILQHELKPNGRNVPVTEENKKEYVRLYVNWRFMRGIEAQFLALQKGFNELIPQHLLKPFDQKELELIIGGLDKIDLNDWKSNTRLKHCVADSNIVRWFWQAVETFDEERRARLLQFVTGSTRVPLQGFKALQGSTGAAGPRLFTIHLIDANTDNLPKAHTCFNRIDIPPYESYEKLYEKLLTAVEETCGFAVE

SEQ ID NO: 866 - protein, 1378 aa, Homo sapiens
  SITE (110)..(110): Xaa at position 110 is Cys, Ala, Val, Gly, Ser, or Thr
  SITE (435)..(435): Xaa at position 435 is Ala, Gly, or Pro
  SITE (437)..(437): Xaa at position 437 is Leu, Ala, Val, Gly, or Ile
  SITE (451)..(451): Xaa at position 451 is Trp, Tyr, Phe, Met, His, Ile, Leu Val, Ala, or Gly
  SITE (473)..(473): Xaa at position 473 is Leu, Ala, Val, Gly, or Ile
  SITE (478)..(478): Xaa at position 478 is Leu, Ala, Val, Gly, or Ile
  SITE (486)..(486): Xaa at position 486 is Tyr, Phe, Met, His, Ile, Leu, Val Ala, or Gly
  SITE (488)..(488): Xaa at position 488 is Cys, Ala, Val, Gly, Ser, or Thr
  SITE (490)..(490): Xaa at position 490 is Ala, Gly, or Pro
  SITE (501)..(501): Xaa at position 501 is Ala, Gly, or Pro
  SITE (503)..(503): Xaa at position 503 is Leu, Ala, Val, Gly, or Ile
  SITE (538)..(538): Xaa at position 538 is Val, Ala, Gly, Leu, or Ile
  SITE (540)..(540): Xaa at position 540 is Leu, Ala, Val, Gly, or Ile
  SITE (557)..(557): Xaa at position 557 is Ile, Ala, Val, Leu, or Gly
  SITE (582)..(582): Xaa at position 582 is Val, Ala, Gly, Leu, or Ile
  SITE (593)..(593): Xaa at position 593 is Phe, Tyr, Met, His, Ile, Leu, Val Ala, or Gly
  SITE (595)..(595): Xaa at position 595 is Val, Ala, Gly, Leu, or Ile
  SITE (597)..(597): Xaa at position 597 is Ala, Gly, or Pro
  SITE (637)..(637): Xaa at position 637 is Val, Ala, Gly, Leu, or Ile
  SITE (652)..(652): Xaa at position 652 is Val, Ala, Gly, Leu, or Ile
  SITE (654)..(654): Xaa at position 654 is Val, Ala, Gly, Leu, or Ile
  SITE (665)..(665): Xaa at position 665 is Ile, Ala, Val, Leu, or Gly
  SITE (668)..(668): Xaa at position 668 is Tyr, Phe, Met, His, Ile, Leu, Val Ala, or Gly
  SITE (670)..(670): Xaa at position 670 is Val, Ala, Gly, Leu, or Ile
  SITE (699)..(699): Xaa at position 699 is Leu, Ala, Val, Gly, or Ile
  SITE (710)..(710): Xaa at position 710 is Ile, Ala, Val, Leu, or Gly
  SITE (712)..(712): Xaa at position 712 is Val, Ala, Gly, Leu, or Ile
MSLLMFTQLLLCGFLYVRVDGSRLRQEDFPPRIVEHPSDVIVSKGEPTTLNCKAEGRPTPTIEWYKDGERVETDKDDPRSHRMLLPSGSLFFLRIVHGRRSKPDEGSYVXVARNYLGEAVSRNASLEVALLRDDFRQNPTDVVVAAGEPAILECQPPRGHPEPTIYWKKDKVRIDDKEERISIRGGKLMISNTRKSDAGMYTCVGTNMVGERDSDPAELTVFERPTFLRRPINQVVLEEEAVEFRCQVQGDPQPTVRWKKDDADLPRGRYDIKDDYTLRIKKTMSTDEGTYMCIAENRVGKMEASATLTVRAPPQFVVRPRDQIVAQGRTVTFPCETKGNPQPAVFWQKEGSQNLLFPNQPQQPNSRCSVSPTGDLTITNIQRSDAGYYICQALTVAGSILAKAQLEVTDVLTDRPPPIILQGPANQTLAVDGTXLXKCKATGDPLPVISXLKEGFTFPGRDPRATIQEQGTXQIKNXRISDTGTXTXVXTSSSGETSWSXVXDVTESGATISKNYDLSDLPGPPSKPQVTDVTKNSXTXSWQPGTPGTLPASAYIXEAFSQSVSNSWQTVANHVKTTLYTXRGLRPNTIYLXMXRXINPQGLSDPSPMSDPVRTQDISPPAQGVDHRQVQKELGDXLVRLHNPVVLTPTTXQXTWTVDRQPQFXQGXRXMYRQTSGLQATSSWQNLDAKVPTERSAVXVNLKKGVTYEXKXRPYFNEFQGMDSESKTVRTTEEAPSAPPQSVTVLTVGSYNSTSISVSWDPPPPDHQNGIIQEYKIWCLGNETRFHINKTVDAAIRSVIIGGLFPGIQYRVEVAASTSAGVGVKSEPQPIIIGRRNEVVITENNNSITEQITDVVKQPAFIAGIGGACWVILMGFSIWLYWRRKKRKGLSNYAVTFQRGDGGLMSNGSRPGLLNAGDPSYPWLADSWPATSLPVNNSNSGPNEIGNFGRGDVLPPVPGQGDKTATMLSDGAIYSSIDFTTKTSYNSSSQITQATPYATTQILHSNSIHELAVDLPDPQWKSSIQQKTDLMGFGYSLPDQNKGNNGGKGGKKKKNKNSSKPQKNNGSTWANVPLPPPPVQPLPGTELEHYAVEQQENGYDSDSWCPPLPVQTYLHQGLEDELEEDDDRVPTPPVRGVASSPAISFGQQSTATLTPSPREEMQPMLQAHLDELTRAYQFDIAKQTWHIQSNNQPPQPPVPPLGYVSGALISDLETDVADDDADDEEEALEIPRPLRALDQTPGSSMDNLDSSVTGKAFTSSQRPRPTSPFSTDSNTSAALSQSQRPRPTKKHKGGRMDQQPALPHRREGMTDEEALVPYSKPSFPSPGGHSSSGTASSKGSTGPRKTEVLRAGHQRNASDLLDIGYMGSNSQGQFTGEL

SEQ ID NO: 867 - protein, 462 aa, Homo sapiens
  SITE (291)..(291): Xaa at position 291 is Leu, Ala, Val, Gly, or Ile
  SITE (313)..(313): Xaa at position 313 is Ile, Ala, Val, Leu, or Gly
  SITE (315)..(315): Xaa at position 315 is Ile, Ala, Val, Leu, or Gly
  SITE (324)..(324): Xaa at position 324 is Ala, Gly, or Pro
  SITE (330)..(330): Xaa at position 330 is Leu, Ala, Val, Gly, or Ile
  SITE (335)..(335): Xaa at position 335 is Ala, Gly, or Pro
  SITE (336)..(336): Xaa at position 336 is Ile, Ala, Val, Leu, or Gly
  SITE (338)..(338): Xaa at position 338 is Ala, Gly, or Pro
  SITE (339)..(339): Xaa at position 339 is Val, Ala, Gly, Leu, or Ile
  SITE (344)..(344): Xaa at position 344 is Leu, Ala, Val, Gly, or Ile
  SITE (352)..(352): Xaa at position 352 is Ala, Gly, or Pro
  SITE (356)..(356): Xaa at position 356 is Leu, Ala, Val, Gly, or Ile
  SITE (363)..(363): Xaa at position 363 is Ile, Ala, Val, Leu, or Gly
  SITE (365)..(365): Xaa at position 365 is Phe, Tyr, Met, His, Ile, Leu, Val Ala, or Gly
  SITE (367)..(367): Xaa at position 367 is Val, Ala, Gly, Leu, or Ile
MSAGGPCPAAAGGGPGGASCSVGAPGGVSMFRWLEVLEKEFDKAFVDVDLLLGEIDPDQADITYEGRQKMTSLSSCFAQLCHKAQSVSQINHKLEAQLVDLKSELTETQAEKVVLEKEVHDQLLQLHSIQLQLHAKTGQSADSGTIKAKLSGPSVEELERELEANKKEKMKEAQLEAEVKLLRKENEALRRHIAVLQAEVYGARLAAKYLDKELAGRVQQIQLLGRDMKGPAHDKLWNQLEAEIHLHRHKTVIRACRGRNDLKRPMQAPPGHDQDSLKKSQGVGPIRKVLXLKEDHEGLGISITGGKEHGVPXLXSEIHPGQPXDRCGGXHVGDXXLXXNGVNXRDTKHKEXVTIXSQQRGEXEXEXVYVAPEVDSDDENVEYEDESGHRYRLYLDELEGGGNPGASCKDTSGEIKVLQGFNKKAVTDTHENGDLGTASETPLDDGASKLDDLHTLYHKKSY

SEQ ID NO: 868 - protein, 637 aa, Homo sapiens
  SITE (96)..(96): Xaa at position 96 is Ile, Ala, Val, Leu, or Gly
  SITE (113)..(113): Xaa at position 113 is Leu, Ala, Val, Gly, or Ile
  SITE (115)..(115): Xaa at position 115 is Val, Ala, Gly, Leu, or Ile
  SITE (117)..(117): Xaa at position 117 is Phe, Tyr, Met, His, Ile, Leu, Val Ala, or Gly
  SITE (125)..(125): Xaa at position 125 is Ile, Ala, Val, Leu, or Gly
  SITE (126)..(126): Xaa at position 126 is Leu, Ala, Val, Gly, or Ile
  SITE (127)..(127): Xaa at position 127 is Val, Ala, Gly, Leu, or Ile
  SITE (129)..(129): Xaa at position 129 is Ile, Ala, Val, Leu, or Gly
  SITE (139)..(139): Xaa at position 139 is Leu, Ala, Val, Gly, or Ile
  SITE (141)..(141): Xaa at position 141 is Leu, Ala, Val, Gly, or Ile
  SITE (143)..(143): Xaa at position 143 is Ile, Ala, Val, Leu, or Gly
  SITE (148)..(148): Xaa at position 148 is Ile, Ala, Val, Leu, or Gly
  SITE (150)..(150): Xaa at position 150 is Val, Ala, Gly, Leu, or Ile
  SITE (152)..(152): Xaa at position 152 is Phe, Tyr, Met, His, Ile, Leu, Val Ala, or Gly
  SITE (159)..(159): Xaa at position 159 is Ile, Ala, Val, Leu, or Gly
  SITE (161)..(161): Xaa at position 161 is Ile, Ala, Val, Leu, or Gly
  SITE (168)..(168): Xaa at position 168 is Val, Ala, Gly, Leu, or Ile
  SITE (176)..(176): Xaa at position 176 is Val, Ala, Gly, Leu, or Ile
  SITE (185)..(185): Xaa at position 185 is Ala, Gly, or Pro
  SITE (187)..(187): Xaa at position 187 is Leu, Ala, Val, Gly, or Ile
  SITE (189)..(189): Xaa at position 189 is Val, Ala, Gly, Leu, or Ile
  SITE (194)..(194): Xaa at position 194 is Val, Ala, Gly, Leu, or Ile
  SITE (204)..(204): Xaa at position 204 is Leu, Ala, Val, Gly, or Ile
  SITE (207)..(207): Xaa at position 207 is Phe, Tyr, Met, His, Ile, Leu, Val Ala, or Gly
  SITE (213)..(213): Xaa at position 213 is Ile, Ala, Val, Leu, or Gly
  SITE (215)..(215): Xaa at position 215 is Ile, Ala, Val, Leu, or Gly
  SITE (224)..(224): Xaa at position 224 is Phe, Tyr, Met, His, Ile, Leu, Val Ala, or Gly
  SITE (228)..(228): Xaa at position 228 is Leu, Ala, Val, Gly, or Ile
  SITE (231)..(231): Xaa at position 231 is Leu, Ala, Val, Gly, or Ile
  SITE (233)..(233): Xaa at position 233 is Tyr, Phe, Met, His, Ile, Leu, Val Ala, or Gly
  SITE (238)..(238): Xaa at position 238 is Val, Ala, Gly, Leu, or Ile
  SITE (239)..(239): Xaa at position 239 is Leu, Ala, Val, Gly, or Ile
  SITE (255)..(255): Xaa at position 255 is Val, Ala, Gly, Leu, or Ile
  SITE (261)..(261): Xaa at position 261 is Val, Ala, Gly, Leu, or Ile
MHLRIHARRSPPRRPAWTLGIWFLFWGCIVSSVWSSSNVASSSSTSSSPGSHSQHEHHFHGSKHHSVPISIYRSPVSLRGGHAGATYIFGKSGGLXLYTWPANDRPSTRSDRXAXGXSTTVKDGXXXRXDSAPGLGDFXQXHXEQGKXGXVXNIGTVDXSXKEERTPXNDGKYHVXRFTRNGGNXTXQXDNWPXNEHYPTGRQXTIXNTQAQXAXGGKDKGRLXQGQXSGXYXDGLKXXNMAAENNPNIKINGSXRLVGEXPSILGTTQTTSMPPEMSTTVMETTTTMATTTTRKNRSTASIQPTSDDLVSSAECSSDDEDFVECEPSTGGELVIPLLVEDPLATPPIATRAPSITLPPTFRPLLTIIETTKDSLSMTSEAGLPCLSDQGSDGCDDDGLVISGYGSGETFDSNLPPTDDEDFYTTFSLVTDKSLSTSIFEGGYKAHAPKWESKDFRPNKVSETSRTTTTSLSPELIRFTASSSSGMVPKLPAGKMNNRDLKPQPDIVLLPLPTAYELDSTKLKSPLITSPMFRNVPTANPTEPGIRRVPGASEVIRESSSTTGMVVGIVAAAALCILILLYAMYKYRNRDEGSYQVDETRNYISNSAQSNGTLMKEKQQSSKSGHKKQKNKDREYYV

SEQ ID NO: 869 - protein, 469 aa, Influenza A virus
  strain A/Brevig Mission/1/1918 H1N1 (Influenza A virus (strain A/South Carolina/1/1918 H1N1))
  SITE (85)..(85): Xaa at position 85 is Leu, Ala, Val, Gly, or Ile
  SITE (106)..(106): Xaa at position 106 is Ile, Ala, Val, Leu, or Gly
  SITE (114)..(114): Xaa at position 114 is Val, Ala, Gly, Leu, or Ile
  SITE (116)..(116): Xaa at position 116 is Val, Ala, Gly, Leu, or Ile
  SITE (121)..(121): Xaa at position 121 is Phe, Tyr, Met, His, Ile, Leu, Val Ala, or Gly
  SITE (122)..(122): Xaa at position 122 is Ile, Ala, Val, Leu, or Gly
  SITE (132)..(132): Xaa at position 132 is Phe, Tyr, Met, His, Ile, Leu, Val Ala, or Gly
  SITE (133)..(133): Xaa at position 133 is Phe, Tyr, Met, His, Ile, Leu, Val Ala, or Gly
  SITE (134)..(134): Xaa at position 134 is Leu, Ala, Val, Gly, or Ile
  SITE (158)..(158): Xaa at position 158 is Leu, Ala, Val, Gly, or Ile
  SITE (161)..(161): Xaa at position 161 is Cys, Ala, Val, Gly, Ser, or Thr
  SITE (178)..(178): Xaa at position 178 is Ala, Gly, or Pro
  SITE (179)..(179): Xaa at position 179 is Trp, Tyr, Phe, Met, His, Ile, Leu Val, Ala, or Gly
  SITE (181)..(181): Xaa at position 181 is Ala, Gly, or Pro
  SITE (183)..(183): Xaa at position 183 is Ala, Gly, or Pro
  SITE (184)..(184): Xaa at position 184 is Cys, Ala, Val, Gly, Ser, or Thr
  SITE (191)..(191): Xaa at position 191 is Leu, Ala, Val, Gly, or Ile
  SITE (193)..(193): Xaa at position 193 is Ile, Ala, Val, Leu, or Gly
  SITE (195)..(195): Xaa at position 195 is Ile, Ala, Val, Leu, or Gly
  SITE (202)..(202): Xaa at position 202 is Ala, Gly, or Pro
  SITE (203)..(203): Xaa at position 203 is Val, Ala, Gly, Leu, or Ile
  SITE (204)..(204): Xaa at position 204 is Ala, Gly, or Pro
  SITE (206)..(206): Xaa at position 206 is Leu, Ala, Val, Gly, or Ile
  SITE (224)..(224): Xaa at position 224 is Leu, Ala, Val, Gly, or Ile
  SITE (232)..(232): Xaa at position 232 is Ala, Gly, or Pro
  SITE (233)..(233): Xaa at position 233 is Cys, Ala, Val, Gly, Ser, or Thr
  SITE (234)..(234): Xaa at position 234 is Val, Ala, Gly, Leu, or Ile
  SITE (239)..(239): Xaa at position 239 is Phe, Tyr, Met, His, Ile, Leu, Val Ala, or Gly
  SITE (241)..(241): Xaa at position 241 is Ile, Ala, Val, Leu, or Gly
  SITE (242)..(242): Xaa at position 242 is Met, Ile, Leu, Val, Ala, or Gly
  SITE (251)..(251): Xaa at position 251 is Ala, Gly, or Pro
  SITE (253)..(253): Xaa at position 253 is Tyr, Phe, Met, His, Ile, Leu, Val Ala, or Gly
  SITE (255)..(255): Xaa at position 255 is Ile, Ala, Val, Leu, or Gly
  SITE (258)..(258): Xaa at position 258 is Ile, Ala, Val, Leu, or Gly
  SITE (263)..(263): Xaa at position 263 is Val, Ala, Gly, Leu, or Ile
  SITE (275)..(275): Xaa at position 275 is His, Phe, Tyr, Lys, Arg, Gly, Ser Thr, Ala, Val, Leu, Ile, Asn, Met, or Gln
  SITE (276)..(276): Xaa at position 276 is Tyr, Phe, Met, His, Ile, Leu, Val Ala, or Gly
  SITE (279)..(279): Xaa at position 279 is Cys, Ala, Val, Gly, Ser, or Thr
  SITE (281)..(281): Xaa at position 281 is Cys, Ala, Val, Gly, Ser, or Thr
  SITE (282)..(282): Xaa at position 282 is Tyr, Phe, Met, His, Ile, Leu, Val Ala, or Gly
  SITE (288)..(288): Xaa at position 288 is Val, Ala, Gly, Leu, or Ile
  SITE (290)..(290): Xaa at position 290 is Cys, Ala, Val, Gly, Ser, or Thr
  SITE (291)..(291): Xaa at position 291 is Val, Ala, Gly, Leu, or Ile
  SITE (292)..(292): Xaa at position 292 is Cys, Ala, Val, Gly, Ser, or Thr
  SITE (304)..(304): Xaa at position 304 is Val, Ala, Gly, Leu, or Ile
  SITE (306)..(306): Xaa at position 306 is Phe, Tyr, Met, His, Ile, Leu, Val Ala, or Gly
  SITE (310)..(310): Xaa at position 310 is Leu, Ala, Val, Gly, or Ile
  SITE (318)..(318): Xaa at position 318 is Cys, Ala, Val, Gly, Ser, or Thr
  SITE (321)..(321): Xaa at position 321 is Val, Ala, Gly, Leu, or Ile
  SITE (322)..(322): Xaa at position 322 is Phe, Tyr, Met, His, Ile, Leu, Val Ala, or Gly
  SITE (349)..(349): Xaa at position 349 is Phe, Tyr, Met, His, Ile, Leu, Val Ala, or Gly
  SITE (351)..(351): Xaa at position 351 is Phe, Tyr, Met, His, Ile, Leu, Val Ala, or Gly
  SITE (353)..(353): Xaa at position 353 is Tyr, Phe, Met, His, Ile, Leu, Val Ala, or Gly
  SITE (357)..(357): Xaa at position 357 is Val, Ala, Gly, Leu, or Ile
  SITE (358)..(358): Xaa at position 358 is Trp, Tyr, Phe, Met, His, Ile, Leu Val, Ala, or Gly
  SITE (359)..(359): Xaa at position 359 is Ile, Ala, Val, Leu, or Gly
  SITE (371)..(371): Xaa at position 371 is Phe, Tyr, Met, His, Ile, Leu, Val Ala, or Gly
  SITE (373)..(373): Xaa at position 373 is Met, Ile, Leu, Val, Ala, or Gly
  SITE (374)..(374): Xaa at position 374 is Ile, Ala, Val, Leu, or Gly
  SITE (387)..(387): Xaa at position 387 is Phe, Tyr, Met, His, Ile, Leu, Val Ala, or Gly
  SITE (393)..(393): Xaa at position 393 is Ile, Ala, Val, Leu, or Gly
  SITE (394)..(394): Xaa at position 394 is Val, Ala, Gly, Leu, or Ile
  SITE (406)..(406): Xaa at position 406 is Phe, Tyr, Met, His, Ile, Leu, Val Ala, or Gly
  SITE (407)..(407): Xaa at position 407 is Val, Ala, Gly, Leu, or Ile
  SITE (418)..(418): Xaa at position 418 is Met, Ile, Leu, Val, Ala, or Gly
  SITE (421)..(421): Xaa at position 421 is Cys, Ala, Val, Gly, Ser, or Thr
  SITE (422)..(422): Xaa at position 422 is Phe, Tyr, Met, His, Ile, Leu, Val Ala, or Gly
  SITE (423)..(423): Xaa at position 423 is Trp, Tyr, Phe, Met, His, Ile, Leu Val, Ala, or Gly
  SITE (424)..(424): Xaa at position 424 is Val, Ala, Gly, Leu, or Ile
  SITE (426)..(426): Xaa at position 426 is Leu, Ala, Val, Gly, or Ile
  SITE (437)..(437): Xaa at position 437 is Trp, Tyr, Phe, Met, His, Ile, Leu Val, Ala, or Gly
  SITE (443)..(443): Xaa at position 443 is Ile, Ala, Val, Leu, or Gly
  SITE (445)..(445): Xaa at position 445 is Phe, Tyr, Met, His, Ile, Leu, Val Ala, or Gly
MNPNQKIITIGSICMVVGIISLILQIGNIISIWVSHSIQTGNQNHPETCNQSIITYENNTWVNQTYVNISNTNVVAGQDATSVIXTGNSSLCPISGWAIYSKDNGXRIGSKGDXFXIREPXXSCSHLECRTXXXTQGALLNDKHSNGTVKDRSPYRTXMSXPVGEAPSPYNSRFESVXXSXSXXHDGMGWXTXGXSGPDNGXXXVXKYNGIITDTIKSWRNNIXRTQESECXXXNGSCXTXXTDGPSNGQXSXKXLKXEKGKXTKSIELNAPNYXXEEXSXXPDTGKXMXXXRDNWHGSNRPWXSXDQNXDYQIGYIXSGXXGDNPRPNDGTGSCGPVSSNGANGIKGXSXRXDNGXXXGRTKSTSSRSGXEXXWDPNGWTETDSSXSVRQDXXAITDWSGYSGSXXQHPELTGLDCXRPXXXXEXIRGQPKENTIXTSGSSXSXCGVNSDTVGWSWPDGAELPFSIDK

SEQ ID NO: 870 - protein, 1324 aa, Murine hepatitis virus
  SITE (79)..(79): Xaa at position 79 is Leu, Ala, Val, Gly, or Ile
  SITE (87)..(87): Xaa at position 87 is Val, Ala, Gly, Leu, or Ile
  SITE (92)..(92): Xaa at position 92 is Phe, Tyr, Met, His, Ile, Leu, Val Ala, or Gly
  SITE (100)..(100): Xaa at position 100 is Phe, Tyr, Met, His, Ile, Leu, Val Ala, or Gly
  SITE (104)..(104): Xaa at position 104 is Ile, Ala, Val, Leu, or Gly
  SITE (106)..(106): Xaa at position 106 is Ala, Gly, or Pro
  SITE (108)..(108): Xaa at position 108 is Val, Ala, Gly, Leu, or Ile
  SITE (123)..(123): Xaa at position 123 is Phe, Tyr, Met, His, Ile, Leu, Val Ala, or Gly
  SITE (126)..(126): Xaa at position 126 is Ile, Ala, Val, Leu, or Gly
  SITE (127)..(127): Xaa at position 127 is Val, Ala, Gly, Leu, or Ile
  SITE (128)..(128): Xaa at position 128 is Ile, Ala, Val, Leu, or Gly
  SITE (132)..(132): Xaa at position 132 is Phe, Tyr, Met, His, Ile, Leu, Val Ala, or Gly
  SITE (139)..(139): Xaa at position 139 is Val, Ala, Gly, Leu, or Ile
  SITE (140)..(140): Xaa at position 140 is Val, Ala, Gly, Leu, or Ile
  SITE (141)..(141): Xaa at position 141 is Ile, Ala, Val, Leu, or Gly
  SITE (148)..(148): Xaa at position 148 is Ile, Ala, Val, Leu, or Gly
  SITE (152)..(152): Xaa at position 152 is Val, Ala, Gly, Leu, or Ile
  SITE (153)..(153): Xaa at position 153 is Cys, Ala, Val, Gly, Ser, or Thr
  SITE (158)..(158): Xaa at position 158 is Cys, Ala, Val, Gly, Ser, or Thr
  SITE (165)..(165): Xaa at position 165 is Cys, Ala, Val, Gly, Ser, or Thr
  SITE (201)..(201): Xaa at position 201 is Ala, Gly, or Pro
  SITE (202)..(202): Xaa at position 202 is Phe, Tyr, Met, His, Ile, Leu, Val Ala, or Gly
  SITE (206)..(206): Xaa at position 206 is Phe, Tyr, Met, His, Ile, Leu, Val Ala, or Gly
  SITE (213)..(213): Xaa at position 213 is Phe, Tyr, Met, His, Ile, Leu, Val Ala, or Gly
  SITE (215)..(215): Xaa at position 215 is Ala, Gly, or Pro
  SITE (226)..(226): Xaa at position 226 is Phe, Tyr, Met, His, Ile, Leu, Val Ala, or Gly
  SITE (232)..(232): Xaa at position 232 is Ile, Ala, Val, Leu, or Gly
  SITE (241)..(241): Xaa at position 241 is Val, Ala, Gly, Leu, or Ile
  SITE (242)..(242): Xaa at position 242 is Leu, Ala, Val, Gly, or Ile
  SITE (244)..(244): Xaa at position 244 is Phe, Tyr, Met, His, Ile, Leu, Val Ala, or Gly
  SITE (246)..(246): Xaa at position 246 is Cys, Ala, Val, Gly, Ser, or Thr
  SITE (258)..(258): Xaa at position 258 is Tyr, Phe, Met, His, Ile, Leu, Val Ala, or Gly
  SITE (260)..(260): Xaa at position 260 is Val, Ala, Gly, Leu, or Ile
  SITE (482)..(482): Xaa at position 482 is Ala, Gly, or Pro
  SITE (891)..(891): Xaa at position 891 is Tyr, Phe, Met, His, Ile, Leu, Val Ala, or Gly
  SITE (900)..(900): Xaa at position 900 is Val, Ala, Gly, Leu, or Ile
  SITE (906)..(906): Xaa at position 906 is Val, Ala, Gly, Leu, or Ile
  SITE (994)..(994): Xaa at position 994 is Ala, Gly, or Pro
  SITE (1053)..(1053): Xaa at position 1053 is Ala, Gly, or Pro
  SITE (1067)..(1067): Xaa at position 1067 is Leu, Ala, Val, Gly, or Ile
  SITE (1113)..(1113): Xaa at position 1113 is Ile, Ala, Val, Leu, or Gly
MLFVFILFLPSCLGYIGDFRCIQLVNSNGANVSAPSISTETVEVSQGLGTYYVLDRVYLNATLLLTGYYPVDGSKFRNXALTGTNSXSLSWXQPPYLSQXNDGXFXKXQNLKTSTPSGATAYXPTXXXGSLXGYTSYTXXXEPYNGVXMASXXQYTIXQLPYTDXKPNTNGNKLIGFWHTDVKPPICVLKRNFTLNVNADXXYFHXYQHGGTXYXYYADKPSATTXLFSVYXGDILTQYYXXPXIXNPTAGSTFAPRXWXTPLVKRQYLFNFNQKGVITSAVDCASSYTSEIKCKTQSMLPSTGVYELSGYTVQPVGVVYRRVANLPACNIEEWLTARSVPSPLNWERKTFQNCNFNLSSLLRYVQAESLFCNNMDASKVYGRCFGSISVDKFAVPRSRQVDLQLGNSGFLQTANYKIDTAATSCQLHYTLPKNNVTINNHNPSSWNRRYGFNDAGVFGKNQHDVVYAQQCFTVRSSYCPCXQPDIVSPCTTQTKPKSAFVNVGDHCEGLGVLEDNCGNADPHKGCICANNSFIGWSHDTCLVNDRCQIFANILLNGINSGTTCSTDLQLPNTEVVTGICVKYDLYGITGQGVFKEVKADYYNSWQTLLYDVNGNLNGFRDLTTNKTYTIRSCYSGRVSAAFHKDAPEPALIYRNINCSYVFSNNISREENPLNYFDSYLGCVVNADNRTDEALPNCDLRMGAGLCVDYSKSRRAHRSVSTGYRLTTFEPYTPMLVNDSVQSVDGLYEMQIPTNFTIGHHEEFIQTRSPKVTIDCAAFVCGDNTACRQQLVEYGSFCVNVNAILNEVNNLLDNMQLQVASALMQGVTISSRLPDGISGPIDDINFSPLLGCIGSTCAEDGNGPSAIRGRSAIEDLLFDKVKLSDVGFVEAXNNCTGGQEXRDLLCXQSFNGIKVLPPVLSESQISGYTTGATAAAMFPPWSAAAGVPFSLSVQYRINGLGVTMNVLSENQKMIASAFNNALGAIQDGFDATNSXLGKIQSVVNANAEALNNLLNQLSNRFGAISASLQEILTRLEAVEAKAQIDRLINGRLTXLNAYISKQLSDSTXIKVSAAQAIEKVNECVKSQNTRINFCGNGNHILSLVQNAPYGLYFXHFSYVPISFTTANVSPGLCISGDRGLAPKAGYFVQDDGEWKFTGSSYYYPEPITDKNSVIMSSCAVNYTKAPEVFLNTSIPNPPDFKEELDKWFKNQTSIAPDLSLDFEKLNVTLLDLTYEMNRIQDAIKKLNESYINLKEVGTYEMYVKWPWYVWLLIGLAGVAVCVLLFFICCCTGCGSCCFKKCGNCCDEYGGHQDSIVIHNISSHED

SEQ ID NO: 871 - protein, 189 aa, Homo sapiens
  SITE (33)..(33): Xaa at position 33 is Cys, Ala, Val, Gly, Ser, or Thr
  SITE (40)..(40): Xaa at position 40 is Leu, Ala, Val, Gly, or Ile
  SITE (44)..(44): Xaa at position 44 is Ala, Gly, or Pro
  SITE (82)..(82): Xaa at position 82 is Leu, Ala, Val, Gly, or Ile
  SITE (89)..(89): Xaa at position 89 is Cys, Ala, Val, Gly, Ser, or Thr
  SITE (90)..(90): Xaa at position 90 is Leu, Ala, Val, Gly, or Ile
  SITE (93)..(93): Xaa at position 93 is Ile, Ala, Val, Leu, or Gly
  SITE (94)..(94): Xaa at position 94 is His, Phe, Tyr, Lys, Arg, Gly, Ser Thr, Ala, Val, Leu, Ile, Asn, Met, or Gln
  SITE (97)..(97): Xaa at position 97 is Leu, Ala, Val, Gly, or Ile
  SITE (100)..(100): Xaa at position 100 is Tyr, Phe, Met, His, Ile, Leu, Val Ala, or Gly
  SITE (109)..(109): Xaa at position 109 is Phe, Tyr, Met, His, Ile, Leu, Val Ala, or Gly
  SITE (124)..(124): Xaa at position 124 is Leu, Ala, Val, Gly, or Ile
  SITE (128)..(128): Xaa at position 128 is Leu, Ala, Val, Gly, or Ile
  SITE (131)..(131): Xaa at position 131 is Leu, Ala, Val, Gly, or Ile
  SITE (150)..(150): Xaa at position 150 is Leu, Ala, Val, Gly, or Ile
  SITE (169)..(169): Xaa at position 169 is Leu, Ala, Val, Gly, or Ile
  SITE (173)..(173): Xaa at position 173 is Val, Ala, Gly, Leu, or Ile
  SITE (176)..(176): Xaa at position 176 is Ala, Gly, or Pro
  SITE (179)..(179): Xaa at position 179 is Val, Ala, Gly, Leu, or Ile
  SITE (180)..(180): Xaa at position 180 is Phe, Tyr, Met, His, Ile, Leu, Val Ala, or Gly
MLGSRAVMLLLLLPWTAQGRAVPGGSSPAWTQXQQLSQKXCTLXWSAHPLVGHMDLREEGDEETTNDVPHIQCGDGCDPQGXRDNSQFXXQRXXQGXIFXEKLLGSDIXTGEPSLLPDSPVGQXHASXLGXSQLLQPEGHHWETQQIPSXSPSQPWQRLLLRFKILRSXQAFXAVXARXXAHGAATLSP

SEQ ID NO: 872 - protein, 335 aa, Homo sapiens
  SITE (39)..(39): Xaa at position 39 is Phe, Tyr, Met, His, Ile, Leu, Val Ala, or Gly
  SITE (51)..(51): Xaa at position 51 is Ile, Ala, Val, Leu, or Gly
  SITE (53)..(53): Xaa at position 53 is Trp, Tyr, Phe, Met, His, Ile, Leu Val, Ala, or Gly
  SITE (90)..(90): Xaa at position 90 is Leu, Ala, Val, Gly, or Ile
  SITE (95)..(95): Xaa at position 95 is Leu, Ala, Val, Gly, or Ile
  SITE (122)..(122): Xaa at position 122 is Leu, Ala, Val, Gly, or Ile
  SITE (124)..(124): Xaa at position 124 is Val, Ala, Gly, Leu, or Ile
  SITE (125)..(125): Xaa at position 125 is Tyr, Phe, Met, His, Ile, Leu, Val Ala, or Gly
  SITE (128)..(128): Xaa at position 128 is Leu, Ala, Val, Gly, or Ile
  SITE (164)..(164): Xaa at position 164 is Trp, Tyr, Phe, Met, His, Ile, Leu Val, Ala, or Gly
  SITE (180)..(180): Xaa at position 180 is Leu, Ala, Val, Gly, or Ile
  SITE (195)..(195): Xaa at position 195 is Cys, Ala, Val, Gly, Ser, or Thr
MAGSPTCLTLIYILWQLTGSAASGPVKELVGSVGGAVTXPLKSKVKQVDSXVXTFNTTPLVTIQPEGGTIIVTQNRNRERVDFPDGGYSXKLSKXKKNDSGIYYVGIYSSSLQQPSTQEYVXHXXEHXSKPKVTMGLQSNKNGTCVTNLTCCMEHGEEDVIYTXKALGQAANESHNGSIXPISWRWGESDMTFIXVARNPVSRNFSSPILARKLCEGAADDPDSSMVLLCLLLVPLLLSLFVLGLFLWFLKRERQEEYIEEKKRVDICRETPNICPHSGENTEYDTIPHTNRTILKEDPANTVYSTVEIPKKMENPHSLLTMPDTPRLFAYENVI

SEQ ID NO: 873 - protein, 1064 aa, Homo sapiens
  SITE (30)..(30): Xaa at position 30 is Cys, Ala, Val, Gly, Ser, or Thr
  SITE (33)..(33): Xaa at position 33 is Phe, Tyr, Met, His, Ile, Leu, Val Ala, or Gly
  SITE (44)..(44): Xaa at position 44 is Cys, Ala, Val, Gly, Ser, or Thr
  SITE (63)..(63): Xaa at position 63 is Cys, Ala, Val, Gly, Ser, or Thr
  SITE (66)..(66): Xaa at position 66 is Cys, Ala, Val, Gly, Ser, or Thr
  SITE (161)..(161): Xaa at position 161 is Cys, Ala, Val, Gly, Ser, or Thr
  SITE (173)..(173): Xaa at position 173 is Leu, Ala, Val, Gly, or Ile
  SITE (194)..(194): Xaa at position 194 is Cys, Ala, Val, Gly, Ser, or Thr
  SITE (197)..(197): Xaa at position 197 is Cys, Ala, Val, Gly, Ser, or Thr
  SITE (225)..(225): Xaa at position 225 is Cys, Ala, Val, Gly, Ser, or Thr
  SITE (237)..(237): Xaa at position 237 is Leu, Ala, Val, Gly, or Ile
  SITE (258)..(258): Xaa at position 258 is Cys, Ala, Val, Gly, Ser, or Thr
  SITE (261)..(261): Xaa at position 261 is Cys, Ala, Val, Gly, Ser, or Thr
  SITE (297)..(297): Xaa at position 297 is Cys, Ala, Val, Gly, Ser, or Thr
  SITE (309)..(309): Xaa at position 309 is Leu, Ala, Val, Gly, or Ile
  SITE (330)..(330): Xaa at position 330 is Cys, Ala, Val, Gly, Ser, or Thr
  SITE (333)..(333): Xaa at position 333 is Cys, Ala, Val, Gly, Ser, or Thr
  SITE (367)..(367): Xaa at position 367 is Cys, Ala, Val, Gly, Ser, or Thr
  SITE (379)..(379): Xaa at position 379 is Leu, Ala, Val, Gly, or Ile
  SITE (400)..(400): Xaa at position 400 is Cys, Ala, Val, Gly, Ser, or Thr
  SITE (403)..(403): Xaa at position 403 is Cys, Ala, Val, Gly, Ser, or Thr
  SITE (437)..(437): Xaa at position 437 is Cys, Ala, Val, Gly, Ser, or Thr
  SITE (449)..(449): Xaa at position 449 is Leu, Ala, Val, Gly, or Ile
  SITE (470)..(470): Xaa at position 470 is Cys, Ala, Val, Gly, Ser, or Thr
  SITE (473)..(473): Xaa at position 473 is Cys, Ala, Val, Gly, Ser, or Thr
  SITE (496)..(496): Xaa at position 496 is Cys, Ala, Val, Gly, Ser, or Thr
  SITE (508)..(508): Xaa at position 508 is Leu, Ala, Val, Gly, or Ile
  SITE (529)..(529): Xaa at position 529 is Cys, Ala, Val, Gly, Ser, or Thr
  SITE (532)..(532): Xaa at position 532 is Cys, Ala, Val, Gly, Ser, or Thr
  SITE (567)..(567): Xaa at position 567 is Cys, Ala, Val, Gly, Ser, or Thr
  SITE (579)..(579): Xaa at position 579 is Leu, Ala, Val, Gly, or Ile
  SITE (600)..(600): Xaa at position 600 is Cys, Ala, Val, Gly, Ser, or Thr
  SITE (602)..(602): Xaa at position 602 is Met, Ile, Leu, Val, Ala, or Gly
  SITE (603)..(603): Xaa at position 603 is Cys, Ala, Val, Gly, Ser, or Thr
  SITE (632)..(632): Xaa at position 632 is Cys, Ala, Val, Gly, Ser, or Thr
  SITE (644)..(644): Xaa at position 644 is Leu, Ala, Val, Gly, or Ile
  SITE (653)..(653): Xaa at position 653 is Val, Ala, Gly, Leu, or Ile
  SITE (665)..(665): Xaa at position 665 is Cys, Ala, Val, Gly, Ser, or Thr
  SITE (667)..(667): Xaa at position 667 is Met, Ile, Leu, Val, Ala, or Gly
  SITE (668)..(668): Xaa at position 668 is Cys, Ala, Val, Gly, Ser, or Thr
  SITE (707)..(707): Xaa at position 707 is Cys, Ala, Val, Gly, Ser, or Thr
  SITE (719)..(719): Xaa at position 719 is Leu, Ala, Val, Gly, or Ile
  SITE (740)..(740): Xaa at position 740 is Cys, Ala, Val, Gly, Ser, or Thr
  SITE (743)..(743): Xaa at position 743 is Cys, Ala, Val, Gly, Ser, or Thr
  SITE (774)..(774): Xaa at position 774 is Cys, Ala, Val, Gly, Ser, or Thr
  SITE (786)..(786): Xaa at position 786 is Leu, Ala, Val, Gly, or Ile
  SITE (807)..(807): Xaa at position 807 is Cys, Ala, Val, Gly, Ser, or Thr
  SITE (810)..(810): Xaa at position 810 is Cys, Ala, Val, Gly, Ser, or Thr
  SITE (849)..(849): Xaa at position 849 is Cys, Ala, Val, Gly, Ser, or Thr
  SITE (861)..(861): Xaa at position 861 is Leu, Ala, Val, Gly, or Ile
  SITE (882)..(882): Xaa at position 882 is Cys, Ala, Val, Gly, Ser, or Thr
  SITE (885)..(885): Xaa at position 885 is Cys, Ala, Val, Gly, Ser, or Thr
  SITE (916)..(916): Xaa at position 916 is Cys, Ala, Val, Gly, Ser, or Thr
  SITE (928)..(928): Xaa at position 928 is Leu, Ala, Val, Gly, or Ile
  SITE (949)..(949): Xaa at position 949 is Cys, Ala, Val, Gly, Ser, or Thr
  SITE (952)..(952): Xaa at position 952 is Cys, Ala, Val, Gly, Ser, or Thr
  SITE (1014)..(1014): Xaa at position 1014 is Cys, Ala, Val, Gly, Ser, or Thr
  SITE (1021)..(1021): Xaa at position 1021 is Tyr, Phe, Met, His, Ile, Leu Val, Ala, or Gly
  SITE (1027)..(1027): Xaa at position 1027 is Leu, Ala, Val, Gly, or Ile
  SITE (1028)..(1028): Xaa at position 1028 is Cys, Ala, Val, Gly, Ser, or Thr
  SITE (1040)..(1040): Xaa at position 1040 is Ile, Ala, Val, Leu, or Gly
MKIATVSVLLPLALCLIQDAASKNEDQEMXHEXQAFMKNGKLFXPQDKKFFQSLDGIMFINKXATXKMILEKEAKSQKRARHLARAPKATAPTELNCDDFKKGERDGDFICPDYYEAVCGTDGKTYDNRCALCAENAKTGSQIGVKSEGECKSSNPEQDVXSAFRPFVRDGRXGCTRENDPVLGPDGKTHGNKXAMXAELFLKEAENAKREGETRIRRNAEKDFXKEYEKQVRNGRXFCTRESDPVRGPDGRMHGNKXALXAEIFKQRFSEENSKTDQNLGKAEEKTKVKREIVKLXSQYQNQAKNGIXFCTRENDPIRGPDGKMHGNLXSMXQAYFQAENEEKKKAEARARNKRESGKATSYAELXSEYRKLVRNGKXACTRENDPIQGPDGKVHGNTXSMXEVFFQAEEEEKKKKEGKSRNKRQSKSTASFEELXSEYRKSRKNGRXFCTRENDPIQGPDGKMHGNTXSMXEAFFQQEERARAKAKREAAKEIXSEFRDQVRNGTXICTREHNPVRGPDGKMHGNKXAMXASVFKLEEEEKKNDKEEKGKVEAEKVKREAVQELXSEYRHYVRNGRXPCTRENDPIEGLDGKIHGNTXSXXEAFFQQEAKEKERAEPRAKVKREAEKETXDEFRRLLQNGKXFCTRENDPXRGPDGKTHGNKXAXXKAVFQKENEERKRKEEEDQRNAAGHGSSGGGGGNTQDEXAEYREQMKNGRXSCTRESDPVRDADGKSYNNQXTMXKAKLEREAERKNEYSRSRSNGTGSESGKDTXDEFRSQMKNGKXICTRESDPVRGPDGKTHGNKXTMXKEKLEREAAEKKKKEDEDRSNTGERSNTGERSNDKEDLXREFRSMQRNGKXICTRENNPVRGPYGKMHINKXAMXQSIFDREANERKKKDEEKSSSKPSNNAKDEXSEFRNYIRNNEXICPRENDPVHGADGKFYTNKXYMXRAVFLTEALERAKLQEKPSHVRASQEEDSPDSFSSLDSEMCKDYRVLPRIGYLCPKDLKPVXGDDGQTXNNPCMXXHENLIRQTNTHXRSTGKCEESSTPGTTAASMPPSDE

SEQ ID NO: 874 - protein, 956 aa, Homo sapiens
  SITE (131)..(131): Xaa at position 131 is Val, Ala, Gly, Leu, or Ile
  SITE (133)..(133): Xaa at position 133 is Val, Ala, Gly, Leu, or Ile
  SITE (146)..(146): Xaa at position 146 is Val, Ala, Gly, Leu, or Ile
  SITE (165)..(165): Xaa at position 165 is Val, Ala, Gly, Leu, or Ile
  SITE (167)..(167): Xaa at position 167 is Leu, Ala, Val, Gly, or Ile
  SITE (193)..(193): Xaa at position 193 is Cys, Ala, Val, Gly, Ser, or Thr
  SITE (195)..(195): Xaa at position 195 is Val, Ala, Gly, Leu, or Ile
  SITE (196)..(196): Xaa at position 196 is Phe, Tyr, Met, His, Ile, Leu, Val Ala, or Gly
  SITE (236)..(236): Xaa at position 236 is Val, Ala, Gly, Leu, or Ile
  SITE (238)..(238): Xaa at position 238 is Leu, Ala, Val, Gly, or Ile
  SITE (249)..(249): Xaa at position 249 is Val, Ala, Gly, Leu, or Ile
  SITE (255)..(255): Xaa at position 255 is Leu, Ala, Val, Gly, or Ile
  SITE (265)..(265): Xaa at position 265 is Val, Ala, Gly, Leu, or Ile
  SITE (267)..(267): Xaa at position 267 is Val, Ala, Gly, Leu, or Ile
  SITE (286)..(286): Xaa at position 286 is Cys, Ala, Val, Gly, Ser, or Thr
  SITE (295)..(295): Xaa at position 295 is Ile, Ala, Val, Leu, or Gly
  SITE (476)..(476): Xaa at position 476 is Ala, Gly, or Pro
  SITE (488)..(488): Xaa at position 488 is Ile, Ala, Val, Leu, or Gly
  SITE (502)..(502): Xaa at position 502 is Ala, Gly, or Pro
  SITE (504)..(504): Xaa at position 504 is Leu, Ala, Val, Gly, or Ile
  SITE (531)..(531): Xaa at position 531 is Ala, Gly, or Pro
  SITE (594)..(594): Xaa at position 594 is Ile, Ala, Val, Leu, or Gly
  SITE (603)..(603): Xaa at position 603 is Leu, Ala, Val, Gly, or Ile
  SITE (607)..(607): Xaa at position 607 is Leu, Ala, Val, Gly, or Ile
  SITE (608)..(608): Xaa at position 608 is Phe, Tyr, Met, His, Ile, Leu, Val Ala, or Gly
  SITE (609)..(609): Xaa at position 609 is Cys, Ala, Val, Gly, Ser, or Thr
  SITE (610)..(610): Xaa at position 610 is Leu, Ala, Val, Gly, or Ile
  SITE (611)..(611): Xaa at position 611 is Phe, Tyr, Met, His, Ile, Leu, Val Ala, or Gly
  SITE (612)..(612): Xaa at position 612 is Ala, Gly, or Pro
  SITE (633)..(633): Xaa at position 633 is Tyr, Phe, Met, His, Ile, Leu, Val Ala, or Gly
  SITE (640)..(640): Xaa at position 640 is Leu, Ala, Val, Gly, or Ile
  SITE (645)..(645): Xaa at position 645 is Val, Ala, Gly, Leu, or Ile
  SITE (654)..(654): Xaa at position 654 is Val, Ala, Gly, Leu, or Ile
  SITE (659)..(659): Xaa at position 659 is Ile, Ala, Val, Leu, or Gly
  SITE (662)..(662): Xaa at position 662 is Leu, Ala, Val, Gly, or Ile
  SITE (666)..(666): Xaa at position 666 is Leu, Ala, Val, Gly, or Ile
  SITE (685)..(685): Xaa at position 685 is Phe, Tyr, Met, His, Ile, Leu, Val Ala, or Gly
  SITE (689)..(689): Xaa at position 689 is Leu, Ala, Val, Gly, or Ile
  SITE (693)..(693): Xaa at position 693 is Ile, Ala, Val, Leu, or Gly
  SITE (700)..(700): Xaa at position 700 is Leu, Ala, Val, Gly, or Ile
  SITE (717)..(717): Xaa at position 717 is Ile, Ala, Val, Leu, or Gly
  SITE (730)..(730): Xaa at position 730 is Ile, Ala, Val, Leu, or Gly
  SITE (745)..(745): Xaa at position 745 is Phe, Tyr, Met, His, Ile, Leu, Val Ala, or Gly
  SITE (752)..(752): Xaa at position 752 is Leu, Ala, Val, Gly, or Ile
  SITE (754)..(754): Xaa at position 754 is Ile, Ala, Val, Leu, or Gly
  SITE (756)..(756): Xaa at position 756 is Met, Ile, Leu, Val, Ala, or Gly
  SITE (775)..(775): Xaa at position 775 is Leu, Ala, Val, Gly, or Ile
  SITE (777)..(777): Xaa at position 777 is Ile, Ala, Val, Leu, or Gly
  SITE (780)..(780): Xaa at position 780 is Leu, Ala, Val, Gly, or Ile
  SITE (788)..(788): Xaa at position 788 is Cys, Ala, Val, Gly, Ser, or Thr
  SITE (802)..(802): Xaa at position 802 is Cys, Ala, Val, Gly, Ser, or Thr
  SITE (816)..(816): Xaa at position 816 is Phe, Tyr, Met, His, Ile, Leu, Val Ala, or Gly
  SITE (863)..(863): Xaa at position 863 is Ala, Gly, or Pro
  SITE (864)..(864): Xaa at position 864 is Val, Ala, Gly, Leu, or Ile
  SITE (865)..(865): Xaa at position 865 is Leu, Ala, Val, Gly, or Ile
  SITE (866)..(866): Xaa at position 866 is Cys, Ala, Val, Gly, Ser, or Thr
  SITE (874)..(874): Xaa at position 874 is Ala, Gly, or Pro
  SITE (875)..(875): Xaa at position 875 is Phe, Tyr, Met, His, Ile, Leu, Val Ala, or Gly
  SITE (876)..(876): Xaa at position 876 is Val, Ala, Gly, Leu, or Ile
  SITE (886)..(886): Xaa at position 886 is Leu, Ala, Val, Gly, or Ile
  SITE (888)..(888): Xaa at position 888 is Phe, Tyr, Met, His, Ile, Leu, Val Ala, or Gly
  SITE (906)..(906): Xaa at position 906 is Val, Ala, Gly, Leu, or Ile
  SITE (909)..(909): Xaa at position 909 is Cys, Ala, Val, Gly, Ser, or Thr
  SITE (912)..(912): Xaa at position 912 is Val, Ala, Gly, Leu, or Ile
  SITE (935)..(935): Xaa at position 935 is Ala, Gly, or Pro
  SITE (945)..(945): Xaa at position 945 is Cys, Ala, Val, Gly, Ser, or Thr
  SITE (947)..(947): Xaa at position 947 is Tyr, Phe, Met, His, Ile, Leu, Val Ala, or Gly
MSSGLWSQEKVTSPYWEERIFYLLLQECSVTDKQTQKLLKVPKGSIGQYIQDRSVGHSRIPSAKGKKNQIGLKILEQPHAVLFVDEKDVVEINEKFTELLLAITNCEERFSLFKNRNRLSKGLQIDVGCPXKXQLRSGEEKFPGVXRFRGPLLAERTVSGIFFGXEXLEEGRGQGFTDGVYQGKQLFQCDEDXGXXVALDKLELIEDDDTALESDYAGPGDTMQVELPPLEINSRXSXKVGETIESGTXIFCDVXPGKESLGYFXGXDMDNPIGNWDGRFDGVQLXSFACVESTXLLHINDIIPALSESVTQERRPPKLAFMSRGVGDKGSSSHNKPKATGSTSDPGNRNRSELFYTLNGSSVDSQPQSKSKNTWYIDEVAEDPAKSLTEISTDFDRSSPPLQPPPVNSLTTENRFHSLPFSLTKMPNTNGSIGHSPLSLSAQSVMEELNTAPVQESPPLAMPPGNSHGLEVGSLXEVKENPPFYGVXRWIGQPPGLNEVLXGXELEDECAGCTDGTFRGTRYFTCALKKXLFVKLKSCRPDSRFASLQPVSNQIERCNSLAFGGYLSEVVEENTPPKMEKEGLEIMIGKKKGXQGHYNSCYXDSTXXXXXXFSSVLDTVLLRPKEKNDVEYXSETQELXRTEIXNPLRIYGYXCATKXMKXRKIXEKVEAASGFTSEEKDPEEXLNIXFHHXLRVEPLXKIRSAGQKVQDCYFYQXFMEKNEKVGVPTXQQLLEWSFINSNLKXAEAPSCXIXQXPRFGKDFKLFKKIFPSLEXNXTDXLEDTPRQXRICGGLAMYECREXYDDPDISAGKIKQXCKTCNTQVHLHPKRLNHKYNPVSLPKDLPDWDWRHGCIPCQNMELFXXXXIETSHYVXXXKYGKDDSAWXFXDSMADRDGGQNGFNIPQXTPXPEXGEYLKMSLEDLHSLDSRRIQGCXRRLLCDAYMXMXQSPTMSLYK

SEQ ID NO: 875 - protein, 1196 aa, Homo sapiens
  SITE (30)..(30): Xaa at position 30 is Ile, Ala, Val, Leu, or Gly
  SITE (32)..(32): Xaa at position 32 is Ala, Gly, or Pro
  SITE (44)..(44): Xaa at position 44 is Cys, Ala, Val, Gly, Ser, or Thr
  SITE (48)..(48): Xaa at position 48 is Phe, Tyr, Met, His, Ile, Leu, Val Ala, or Gly
  SITE (49)..(49): Xaa at position 49 is Cys, Ala, Val, Gly, Ser, or Thr
  SITE (51)..(51): Xaa at position 51 is Met, Ile, Leu, Val, Ala, or Gly
  SITE (59)..(59): Xaa at position 59 is Val, Ala, Gly, Leu, or Ile
  SITE (64)..(64): Xaa at position 64 is Cys, Ala, Val, Gly, Ser, or Thr
  SITE (66)..(66): Xaa at position 66 is Cys, Ala, Val, Gly, Ser, or Thr
  SITE (82)..(82): Xaa at position 82 is Ile, Ala, Val, Leu, or Gly
  SITE (83)..(83): Xaa at position 83 is Ala, Gly, or Pro
  SITE (96)..(96): Xaa at position 96 is Val, Ala, Gly, Leu, or Ile
  SITE (98)..(98): Xaa at position 98 is Tyr, Phe, Met, His, Ile, Leu, Val Ala, or Gly
  SITE (112)..(112): Xaa at position 112 is Ile, Ala, Val, Leu, or Gly
  SITE (127)..(127): Xaa at position 127 is Ile, Ala, Val, Leu, or Gly
  SITE (766)..(766): Xaa at position 766 is Ala, Gly, or Pro
  SITE (781)..(781): Xaa at position 781 is Ala, Gly, or Pro
  SITE (785)..(785): Xaa at position 785 is Leu, Ala, Val, Gly, or Ile
  SITE (790)..(790): Xaa at position 790 is Ile, Ala, Val, Leu, or Gly
  SITE (807)..(807): Xaa at position 807 is Ile, Ala, Val, Leu, or Gly
  SITE (808)..(808): Xaa at position 808 is Phe, Tyr, Met, His, Ile, Leu, Val Ala, or Gly
  SITE (825)..(825): Xaa at position 825 is Val, Ala, Gly, Leu, or Ile
  SITE (827)..(827): Xaa at position 827 is Ala, Gly, or Pro
  SITE (833)..(833): Xaa at position 833 is Leu, Ala, Val, Gly, or Ile
  SITE (844)..(844): Xaa at position 844 is Val, Ala, Gly, Leu, or Ile
MPVRRGHVAPQNTFLGTIIRKFEGQNKKFXIXNARVQNCAIIYXNDGXXEXTGFSRPDXMQKPXTXDFLHGPETKRHDIAQXXQALLGSEERKVEXTXYHKNGSTFICNTHXIPVKNQEGVAMMFIXNFEYVTDNENAATPERVNPILPIKTVNRKFFGFKFPGLRVLTYRKQSLPQEDPDVVVIDSSKHSDDSVAMKHFKSPTKESCSPSEADDTKALIQPSKCSPLVNISGPLDHSSPKRQWDRLYPDMLQSSSQLSHSRSRESLCSIRRASSVHDIEGFGVHPKNIFRDRHASEDNGRNVKGPFNHIKSSLLGSTSDSNLNKYSTINKIPQLTLNFSEVKTEKKNSSPPSSDKTIIAPKVKDRTHNVTEKVTQVLSLGADVLPEYKLQTPRINKFTILHYSPFKAVWDWLILLLVIYTAIFTPYSAAFLLNDREEQKRRECGYSCSPLNVVDLIVDIMFIIDILINFRTTYVNQNEEVVSDPAKIAIHYFKGWFLIDMVAAIPFDLLIFGSGSDETTTLIGLLKTARLLRLVRVARKLDRYSEYGAAVLMLLMCIFALIAHWLACIWYAIGNVERPYLTDKIGWLDSLGQQIGKRYNDSDSSSGPSIKDKYVTALYFTFSSLTSVGFGNVSPNTNSEKIFSICVMLIGSLMYASIFGNVSAIIQRLYSGTARYHMQMLRVKEFIRFHQIPNPLRQRLEEYFQHAWTYTNGIDMNMVLKGFPECLQADICLHLNQTLLQNCKAFRGASKGCLRALAMKFKTTHXPPGDTLVHCGDVLTXLYFXSRGSXEILKDDIVVAILGKNDXXGEMVHLYAKPGKSNADXRXLTYCDXHKIQREDLLEXLDMYPEFSDHFLTNLELTFNLRHESAKADLLRSQSMNDSEGDNCKLRRRKLSFESEGEKENSTNDPEDSADTIRHYQSSKRHFEEKKSRSSSFISSIDDEQKPLFSGIVDSSPGIGKASGLDFEETVPTSGRMHIDKRSHSCKDITDMRSWERENAHPQPEDSSPSALQRAAWGISETESDLTYGEVEQRLDLLQEQLNRLESQMTTDIQTILQLLQKQTTVVPPAYSMVTAGSEYQRPIIQLMRTSQPEASIKTDRSFSPSSQCPEFLDLEKSKLKSKESLSSGVHLNTASEDNLTSLLKQDSDLSLELHLRQRKTYVHPIRHPSLPDSSLSTVGIVGLHRHVSDPGLPGK

SEQ ID NO: 876 - protein, 429 aa, Homo sapiens
  SITE (42)..(42): Xaa at position 42 is Phe, Tyr, Met, His, Ile, Leu, Val Ala, or Gly
  SITE (44)..(44): Xaa at position 44 is Ile, Ala, Val, Leu, or Gly
  SITE (45)..(45): Xaa at position 45 is Leu, Ala, Val, Gly, or Ile
  SITE (46)..(46): Xaa at position 46 is Cys, Ala, Val, Gly, Ser, or Thr
  SITE (47)..(47): Xaa at position 47 is Val, Ala, Gly, Leu, or Ile
  SITE (57)..(57): Xaa at position 57 is Leu, Ala, Val, Gly, or Ile
  SITE (58)..(58): Xaa at position 58 is Met, Ile, Leu, Val, Ala, or Gly
  SITE (92)..(92): Xaa at position 92 is Val, Ala, Gly, Leu, or Ile
  SITE (94)..(94): Xaa at position 94 is Leu, Ala, Val, Gly, or Ile
  SITE (96)..(96): Xaa at position 96 is Leu, Ala, Val, Gly, or Ile
  SITE (99)..(99): Xaa at position 99 is Val, Ala, Gly, Leu, or Ile
  SITE (114)..(114): Xaa at position 114 is Tyr, Phe, Met, His, Ile, Leu, Val Ala, or Gly
  SITE (117)..(117): Xaa at position 117 is Ile, Ala, Val, Leu, or Gly
  SITE (121)..(121): Xaa at position 121 is Ile, Ala, Val, Leu, or Gly
  SITE (125)..(125): Xaa at position 125 is Phe, Tyr, Met, His, Ile, Leu, Val Ala, or Gly
  SITE (129)..(129): Xaa at position 129 is Leu, Ala, Val, Gly, or Ile
  SITE (149)..(149): Xaa at position 149 is Ala, Gly, or Pro
  SITE (150)..(150): Xaa at position 150 is Cys, Ala, Val, Gly, Ser, or Thr
  SITE (151)..(151): Xaa at position 151 is Leu, Ala, Val, Gly, or Ile
  SITE (154)..(154): Xaa at position 154 is Ile, Ala, Val, Leu, or Gly
  SITE (169)..(169): Xaa at position 169 is Met, Ile, Leu, Val, Ala, or Gly
  SITE (172)..(172): Xaa at position 172 is Leu, Ala, Val, Gly, or Ile
  SITE (176)..(176): Xaa at position 176 is Val, Ala, Gly, Leu, or Ile
  SITE (178)..(178): Xaa at position 178 is Ile, Ala, Val, Leu, or Gly
  SITE (179)..(179): Xaa at position 179 is Ile, Ala, Val, Leu, or Gly
  SITE (181)..(181): Xaa at position 181 is Ile, Ala, Val, Leu, or Gly
  SITE (182)..(182): Xaa at position 182 is Ile, Ala, Val, Leu, or Gly
  SITE (183)..(183): Xaa at position 183 is Ala, Gly, or Pro
  SITE (196)..(196): Xaa at position 196 is Phe, Tyr, Met, His, Ile, Leu, Val Ala, or Gly
  SITE (200)..(200): Xaa at position 200 is Ile, Ala, Val, Leu, or Gly
  SITE (228)..(228): Xaa at position 228 is Met, Ile, Leu, Val, Ala, or Gly
  SITE (234)..(234): Xaa at position 234 is Phe, Tyr, Met, His, Ile, Leu, Val Ala, or Gly
  SITE (237)..(237): Xaa at position 237 is Val, Ala, Gly, Leu, or Ile
  SITE (252)..(252): Xaa at position 252 is Ala, Gly, or Pro
  SITE (262)..(262): Xaa at position 262 is Val, Ala, Gly, Leu, or Ile
  SITE (270)..(270): Xaa at position 270 is Phe, Tyr, Met, His, Ile, Leu, Val Ala, or Gly
  SITE (273)..(273): Xaa at position 273 is Leu, Ala, Val, Gly, or Ile
  SITE (276)..(276): Xaa at position 276 is Met, Ile, Leu, Val, Ala, or Gly
  SITE (285)..(285): Xaa at position 285 is Leu, Ala, Val, Gly, or Ile
  SITE (293)..(293): Xaa at position 293 is His, Phe, Tyr, Lys, Arg, Gly, Ser Thr, Ala, Val, Leu, Ile, Asn, Met, or Gln
  SITE (294)..(294): Xaa at position 294 is Tyr, Phe, Met, His, Ile, Leu, Val Ala, or Gly
MAVAVGRPSNEELRNLSLSGHVGFDSLPDQLVNKSTSQGFCXNXXXXGETGIGKSTXXDTLFNTKFESDPATHNEPGVRLKARSYELQESNXRXKXTIXDTVGFGDQINKDDSXKPXVEYXDAQXEAYXQEELKIKRSLFNYHDTRIHXXXYFXAPTGHSLKSLDLVTXKKXDSKXNXXPXXXKADTIAKNELHKXKSKXMSELVSNGVQIYQFPTDEETVAEINATXSVHLPXAVXGSTEEVKIGNKMAKXRQYPWGVVQXENENHCDXVKXREXLIRVNMEDXREQTHTRXXELYRRCKLEEMGFKDTDPDSKPFSLQETYEAKRNEFLGELQKKEEEMRQMFVMRVKEKEAELKEAEKELHEKFDLLKRTHQEEKKKVEDKKKELEEEVNNFQKKKAAAQLLQSQAQQSGAQQTKKDKDKKNASFT

SEQ ID NO: 877 - protein, 372 aa, Homo sapiens
  SITE (268)..(268): Xaa at position 268 is Leu, Ala, Val, Gly, or Ile
  SITE (272)..(272): Xaa at position 272 is Val, Ala, Gly, Leu, or Ile
  SITE (275)..(275): Xaa at position 275 is His, Phe, Tyr, Lys, Arg, Gly, Ser Thr, Ala, Val, Leu, Ile, Asn, Met, or Gln
  SITE (276)..(276): Xaa at position 276 is Leu, Ala, Val, Gly, or Ile
  SITE (283)..(283): Xaa at position 283 is Val, Ala, Gly, Leu, or Ile
  SITE (286)..(286): Xaa at position 286 is Leu, Ala, Val, Gly, or Ile
  SITE (290)..(290): Xaa at position 290 is Phe, Tyr, Met, His, Ile, Leu, Val Ala, or Gly
  SITE (296)..(296): Xaa at position 296 is Leu, Ala, Val, Gly, or Ile
  SITE (297)..(297): Xaa at position 297 is Val, Ala, Gly, Leu, or Ile
  SITE (299)..(299): Xaa at position 299 is Leu, Ala, Val, Gly, or Ile
  SITE (300)..(300): Xaa at position 300 is Met, Ile, Leu, Val, Ala, or Gly
  SITE (308)..(308): Xaa at position 308 is Val, Ala, Gly, Leu, or Ile
  SITE (327)..(327): Xaa at position 327 is Val, Ala, Gly, Leu, or Ile
  SITE (330)..(330): Xaa at position 330 is Ala, Gly, or Pro
  SITE (334)..(334): Xaa at position 334 is Met, Ile, Leu, Val, Ala, or Gly
  SITE (339)..(339): Xaa at position 339 is Leu, Ala, Val, Gly, or Ile
  SITE (349)..(349): Xaa at position 349 is Ile, Ala, Val, Leu, or Gly
  SITE (358)..(358): Xaa at position 358 is Leu, Ala, Val, Gly, or Ile
  SITE (360)..(360): Xaa at position 360 is Val, Ala, Gly, Leu, or Ile
  SITE (361)..(361): Xaa at position 361 is Leu, Ala, Val, Gly, or Ile
  SITE (364)..(364): Xaa at position 364 is Leu, Ala, Val, Gly, or Ile
MATSPQKSPSVPKSPTPKSPPSRKKDDSFLGKLGGTLARRKKAKEVSELQEEGMNAINLPLSPIPFELDPEDTMLEENEVRTMVDPNSRSDPKLQELMKVLIDWINDVLVGERIIVKDLAEDLYDGQVLQKLFEKLESEKLNVAEVTQSEIAQKQKLQTVLEKINETLKLPPRSIKWNVDSVHAKSLVAILHLLVALSQYFRAPIRLPDHVSIQVVVVQKREGILQSRQIQEEITGNTEALSGRHERDAFDTLFDHAPDKLNVVKKTXITFXNKXXNKLNLEXTEXETQXADGVYXXLXXGLLEGYFXPLHSFFLTPDSFEQKVLNXSFXFELXQDGGXEKPKPRPEDXVNCDLKSTXRXXYNXFTKYRNVE

SEQ ID NO: 878 - protein, 215 aa, Homo sapiens
  SITE (43)..(43): Xaa at position 43 is Leu, Ala, Val, Gly, or Ile
  SITE (45)..(45): Xaa at position 45 is Cys, Ala, Val, Gly, Ser, or Thr
  SITE (60)..(60): Xaa at position 60 is Val, Ala, Gly, Leu, or Ile
  SITE (62)..(62): Xaa at position 62 is Trp, Tyr, Phe, Met, His, Ile, Leu Val, Ala, or Gly
  SITE (103)..(103): Xaa at position 103 is Val, Ala, Gly, Leu, or Ile
  SITE (105)..(105): Xaa at position 105 is Ile, Ala, Val, Leu, or Gly
  SITE (107)..(107): Xaa at position 107 is Val, Ala, Gly, Leu, or Ile
  SITE (118)..(118): Xaa at position 118 is Tyr, Phe, Met, His, Ile, Leu, Val Ala, or Gly
  SITE (120)..(120): Xaa at position 120 is Cys, Ala, Val, Gly, Ser, or Thr
  SITE (122)..(122): Xaa at position 122 is Val, Ala, Gly, Leu, or Ile
MPAFNRLFPLASLVLIYWVSVCFPVCVEVPSETEAVQGNPMKXRXISCMKREEVEATTVXEXFYRPEGGKDFLIYEYRNGHQEVESPFQGRLQWNGSKDLQDXSXTXLNVTLNDSGLXTXNXSREFEFEAHRPFVKTTRLIPLRVTEEAGEDFTSVVSEIMMYILLVFLTLWLLIEMIYCYRKVSKAEEAAQENASDYLAIPSENKENSAVPVEE

SEQ ID NO: 879 - protein, 941 aa, Homo sapiens
  SITE (47)..(47): Xaa at position 47 is Phe, Tyr, Met, His, Ile, Leu, Val Ala, or Gly
  SITE (57)..(57): Xaa at position 57 is Tyr, Phe, Met, His, Ile, Leu, Val Ala, or Gly
  SITE (63)..(63): Xaa at position 63 is Tyr, Phe, Met, His, Ile, Leu, Val Ala, or Gly
  SITE (65)..(65): Xaa at position 65 is Leu, Ala, Val, Gly, or Ile
  SITE (67)..(67): Xaa at position 67 is Ile, Ala, Val, Leu, or Gly
  SITE (71)..(71): Xaa at position 71 is Leu, Ala, Val, Gly, or Ile
  SITE (76)..(76): Xaa at position 76 is Phe, Tyr, Met, His, Ile, Leu, Val Ala, or Gly
  SITE (82)..(82): Xaa at position 82 is Val, Ala, Gly, Leu, or Ile
  SITE (84)..(84): Xaa at position 84 is Ile, Ala, Val, Leu, or Gly
  SITE (86)..(86): Xaa at position 86 is Ala, Gly, or Pro
  SITE (93)..(93): Xaa at position 93 is Ile, Ala, Val, Leu, or Gly
  SITE (94)..(94): Xaa at position 94 is Ile, Ala, Val, Leu, or Gly
  SITE (95)..(95): Xaa at position 95 is Leu, Ala, Val, Gly, or Ile
  SITE (105)..(105): Xaa at position 105 is Ala, Gly, or Pro
  SITE (107)..(107): Xaa at position 107 is Leu, Ala, Val, Gly, or Ile
  SITE (115)..(115): Xaa at position 115 is Leu, Ala, Val, Gly, or Ile
  SITE (123)..(123): Xaa at position 123 is Leu, Ala, Val, Gly, or Ile
  SITE (131)..(131): Xaa at position 131 is Ile, Ala, Val, Leu, or Gly
  SITE (132)..(132): Xaa at position 132 is Ala, Gly, or Pro
  SITE (133)..(133): Xaa at position 133 is Leu, Ala, Val, Gly, or Ile
  SITE (139)..(139): Xaa at position 139 is Leu, Ala, Val, Gly, or Ile
  SITE (140)..(140): Xaa at position 140 is Leu, Ala, Val, Gly, or Ile
  SITE (141)..(141): Xaa at position 141 is Val, Ala, Gly, Leu, or Ile
  SITE (145)..(145): Xaa at position 145 is Tyr, Phe, Met, His, Ile, Leu, Val Ala, or Gly
  SITE (147)..(147): Xaa at position 147 is Val, Ala, Gly, Leu, or Ile
  SITE (148)..(148): Xaa at position 148 is Val, Ala, Gly, Leu, or Ile
  SITE (149)..(149): Xaa at position 149 is Ile, Ala, Val, Leu, or Gly
  SITE (151)..(151): Xaa at position 151 is Tyr, Phe, Met, His, Ile, Leu, Val Ala, or Gly
  SITE (163)..(163): Xaa at position 163 is Tyr, Phe, Met, His, Ile, Leu, Val Ala, or Gly
  SITE (177)..(177): Xaa at position 177 is Leu, Ala, Val, Gly, or Ile
  SITE (178)..(178): Xaa at position 178 is Ala, Gly, or Pro
  SITE (182)..(182): Xaa at position 182 is Phe, Tyr, Met, His, Ile, Leu, Val Ala, or Gly
  SITE (186)..(186): Xaa at position 186 is Ala, Gly, or Pro
  SITE (187)..(187): Xaa at position 187 is Ala, Gly, or Pro
  SITE (190)..(190): Xaa at position 190 is Ala, Gly, or Pro
  SITE (191)..(191): Xaa at position 191 is Phe, Tyr, Met, His, Ile, Leu, Val Ala, or Gly
  SITE (193)..(193): Xaa at position 193 is Cys, Ala, Val, Gly, Ser, or Thr
  SITE (194)..(194): Xaa at position 194 is Phe, Tyr, Met, His, Ile, Leu, Val Ala, or Gly
  SITE (201)..(201): Xaa at position 201 is Ala, Gly, or Pro
  SITE (203)..(203): Xaa at position 203 is Phe, Tyr, Met, His, Ile, Leu, Val Ala, or Gly
  SITE (205)..(205): Xaa at position 205 is Ile, Ala, Val, Leu, or Gly
  SITE (207)..(207): Xaa at position 207 is Ile, Ala, Val, Leu, or Gly
  SITE (236)..(236): Xaa at position 236 is Phe, Tyr, Met, His, Ile, Leu, Val Ala, or Gly
  SITE (242)..(242): Xaa at position 242 is Met, Ile, Leu, Val, Ala, or Gly
  SITE (245)..(245): Xaa at position 245 is Tyr, Phe, Met, His, Ile, Leu, Val Ala, or Gly
  SITE (246)..(246): Xaa at position 246 is Leu, Ala, Val, Gly, or Ile
  SITE (247)..(247): Xaa at position 247 is Val, Ala, Gly, Leu, or Ile
  SITE (248)..(248): Xaa at position 248 is Ala, Gly, or Pro
  SITE (249)..(249): Xaa at position 249 is Phe, Tyr, Met, His, Ile, Leu, Val Ala, or Gly
  SITE (250)..(250): Xaa at position 250 is Ile, Ala, Val, Leu, or Gly
  SITE (251)..(251): Xaa at position 251 is Ile, Ala, Val, Leu, or Gly
  SITE (267)..(267): Xaa at position 267 is Val, Ala, Gly, Leu, or Ile
  SITE (269)..(269): Xaa at position 269 is Val, Ala, Gly, Leu, or Ile
  SITE (271)..(271): Xaa at position 271 is Ala, Gly, or Pro
  SITE (279)..(279): Xaa at position 279 is Ala, Gly, or Pro
  SITE (281)..(281): Xaa at position 281 is Tyr, Phe, Met, His, Ile, Leu, Val Ala, or Gly
  SITE (282)..(282): Xaa at position 282 is Ala, Gly, or Pro
  SITE (283)..(283): Xaa at position 283 is Leu, Ala, Val, Gly, or Ile
  SITE (285)..(285): Xaa at position 285 is Ala, Gly, or Pro
  SITE (286)..(286): Xaa at position 286 is Ala, Gly, or Pro
  SITE (289)..(289): Xaa at position 289 is Leu, Ala, Val, Gly, or Ile
  SITE (290)..(290): Xaa at position 290 is Leu, Ala, Val, Gly, or Ile
  SITE (293)..(293): Xaa at position 293 is Tyr, Phe, Met, His, Ile, Leu, Val Ala, or Gly
  SITE (297)..(297): Xaa at position 297 is Phe, Tyr, Met, His, Ile, Leu, Val Ala, or Gly
  SITE (308)..(308): Xaa at position 308 is Leu, Ala, Val, Gly, or Ile
  SITE (309)..(309): Xaa at position 309 is Ala, Gly, or Pro
  SITE (310)..(310): Xaa at position 310 is Ala, Gly, or Pro
  SITE (311)..(311): Xaa at position 311 is Ile, Ala, Val, Leu, or Gly
  SITE (314)..(314): Xaa at position 314 is Phe, Tyr, Met, His, Ile, Leu, Val Ala, or Gly
  SITE (318)..(318): Xaa at position 318 is Ala, Gly, or Pro
  SITE (319)..(319): Xaa at position 319 is Met, Ile, Leu, Val, Ala, or Gly
  SITE (322)..(322): Xaa at position 322 is Trp, Tyr, Phe, Met, His, Ile, Leu Val, Ala, or Gly
  SITE (324)..(324): Xaa at position 324 is Leu, Ala, Val, Gly, or Ile
  SITE (327)..(327): Xaa at position 327 is Tyr, Phe, Met, His, Ile, Leu, Val Ala, or Gly
  SITE (331)..(331): Xaa at position 331 is Ala, Gly, or Pro
  SITE (332)..(332): Xaa at position 332 is Leu, Ala, Val, Gly, or Ile
  SITE (333)..(333): Xaa at position 333 is Leu, Ala, Val, Gly, or Ile
  SITE (347)..(347): Xaa at position 347 is Ile, Ala, Val, Leu, or Gly
  SITE (351)..(351): Xaa at position 351 is Val, Ala, Gly, Leu, or Ile
  SITE (352)..(352): Xaa at position 352 is Ala, Gly, or Pro
  SITE (355)..(355): Xaa at position 355 is Leu, Ala, Val, Gly, or Ile
  SITE (356)..(356): Xaa at position 356 is Ala, Gly, or Pro
  SITE (357)..(357): Xaa at position 357 is His, Phe, Tyr, Lys, Arg, Gly, Ser Thr, Ala, Val, Leu, Ile, Asn, Met, or Gln
  SITE (359)..(359): Xaa at position 359 is Trp, Tyr, Phe, Met, His, Ile, Leu Val, Ala, or Gly
  SITE (360)..(360): Xaa at position 360 is Phe, Tyr, Met, His, Ile, Leu, Val Ala, or Gly
  SITE (363)..(363): Xaa at position 363 is Leu, Ala, Val, Gly, or Ile
  SITE (366)..(366): Xaa at position 366 is Met, Ile, Leu, Val, Ala, or Gly
  SITE (369)..(369): Xaa at position 369 is Trp, Tyr, Phe, Met, His, Ile, Leu Val, Ala, or Gly
  SITE (372)..(372): Xaa at position 372 is Leu, Ala, Val, Gly, or Ile
  SITE (373)..(373): Xaa at position 373 is Trp, Tyr, Phe, Met, His, Ile, Leu Val, Ala, or Gly
  SITE (374)..(374): Xaa at position 374 is Leu, Ala, Val, Gly, or Ile
  SITE (378)..(378): Xaa at position 378 is Phe, Tyr, Met, His, Ile, Leu, Val Ala, or Gly
  SITE (379)..(379): Xaa at position 379 is Ala, Gly, or Pro
  SITE (381)..(381): Xaa at position 381 is Phe, Tyr, Met, His, Ile, Leu, Val Ala, or Gly
  SITE (382)..(382): Xaa at position 382 is Met, Ile, Leu, Val, Ala, or Gly
  SITE (387)..(387): Xaa at position 387 is Val, Ala, Gly, Leu, or Ile
  SITE (394)..(394): Xaa at position 394 is Leu, Ala, Val, Gly, or Ile
  SITE (396)..(396): Xaa at position 396 is Val, Ala, Gly, Leu, or Ile
  SITE (405)..(405): Xaa at position 405 is Phe, Tyr, Met, His, Ile, Leu, Val Ala, or Gly
  SITE (407)..(407): Xaa at position 407 is Ala, Gly, or Pro
  SITE (408)..(408): Xaa at position 408 is Met, Ile, Leu, Val, Ala, or Gly
  SITE (412)..(412): Xaa at position 412 is Ala, Gly, or Pro
  SITE (419)..(419): Xaa at position 419 is Val, Ala, Gly, Leu, or Ile
  SITE (423)..(423): Xaa at position 423 is Val, Ala, Gly, Leu, or Ile
  SITE (432)..(432): Xaa at position 432 is Met, Ile, Leu, Val, Ala, or Gly
  SITE (436)..(436): Xaa at position 436 is Val, Ala, Gly, Leu, or Ile
  SITE (442)..(442): Xaa at position 442 is Ala, Gly, or Pro
  SITE (443)..(443): Xaa at position 443 is Cys, Ala, Val, Gly, Ser, or Thr
  SITE (444)..(444): Xaa at position 444 is Ile, Ala, Val, Leu, or Gly
  SITE (445)..(445): Xaa at position 445 is Leu, Ala, Val, Gly, or Ile
  SITE (448)..(448): Xaa at position 448 is Leu, Ala, Val, Gly, or Ile
  SITE (457)..(457): Xaa at position 457 is Phe, Tyr, Met, His, Ile, Leu, Val Ala, or Gly
  SITE (461)..(461): Xaa at position 461 is Ile, Ala, Val, Leu, or Gly
  SITE (465)..(465): Xaa at position 465 is Leu, Ala, Val, Gly, or Ile
  SITE (478)..(478): Xaa at position 478 is Leu, Ala, Val, Gly, or Ile
  SITE (479)..(479): Xaa at position 479 is Trp, Tyr, Phe, Met, His, Ile, Leu Val, Ala, or Gly
  SITE (482)..(482): Xaa at position 482 is Met, Ile, Leu, Val, Ala, or Gly
  SITE (517)..(517): Xaa at position 517 is Val, Ala, Gly, Leu, or Ile
  SITE (520)..(520): Xaa at position 520 is Met, Ile, Leu, Val, Ala, or Gly
  SITE (521)..(521): Xaa at position 521 is Met, Ile, Leu, Val, Ala, or Gly
  SITE (524)..(524): Xaa at position 524 is Trp, Tyr, Phe, Met, His, Ile, Leu Val, Ala, or Gly
  SITE (530)..(530): Xaa at position 530 is Phe, Tyr, Met, His, Ile, Leu, Val Ala, or Gly
  SITE (532)..(532): Xaa at position 532 is Leu, Ala, Val, Gly, or Ile
  SITE (533)..(533): Xaa at position 533 is Ile, Ala, Val, Leu, or Gly
  SITE (535)..(535): Xaa at position 535 is Ile, Ala, Val, Leu, or Gly
  SITE (542)..(542): Xaa at position 542 is Val, Ala, Gly, Leu, or Ile
  SITE (544)..(544): Xaa at position 544 is Met, Ile, Leu, Val, Ala, or Gly
  SITE (549)..(549): Xaa at position 549 is Tyr, Phe, Met, His, Ile, Leu, Val Ala, or Gly
  SITE (563)..(563): Xaa at position 563 is Trp, Tyr, Phe, Met, His, Ile, Leu Val, Ala, or Gly
  SITE (565)..(565): Xaa at position 565 is Val, Ala, Gly, Leu, or Ile
  SITE (567)..(567): Xaa at position 567 is Leu, Ala, Val, Gly, or Ile
  SITE (582)..(582): Xaa at position 582 is Leu, Ala, Val, Gly, or Ile
  SITE (600)..(600): Xaa at position 600 is Phe, Tyr, Met, His, Ile, Leu, Val Ala, or Gly
  SITE (604)..(604): Xaa at position 604 is Met, Ile, Leu, Val, Ala, or Gly
  SITE (607)..(607): Xaa at position 607 is Tyr, Phe, Met, His, Ile, Leu, Val Ala, or Gly
  SITE (608)..(608): Xaa at position 608 is Tyr, Phe, Met, His, Ile, Leu, Val Ala, or Gly
  SITE (609)..(609): Xaa at position 609 is Ile, Ala, Val, Leu, or Gly
  SITE (610)..(610): Xaa at position 610 is Val, Ala, Gly, Leu, or Ile
  SITE (620)..(620): Xaa at position 620 is Leu, Ala, Val, Gly, or Ile
  SITE (624)..(624): Xaa at position 624 is Leu, Ala, Val, Gly, or Ile
  SITE (631)..(631): Xaa at position 631 is Val, Ala, Gly, Leu, or Ile
  SITE (637)..(637): Xaa at position 637 is Ala, Gly, or Pro
  SITE (639)..(639): Xaa at position 639 is Leu, Ala, Val, Gly, or Ile
  SITE (640)..(640): Xaa at position 640 is Ile, Ala, Val, Leu, or Gly
  SITE (643)..(643): Xaa at position 643 is Ala, Gly, or Pro
  SITE (646)..(646): Xaa at position 646 is Leu, Ala, Val, Gly, or Ile
  SITE (654)..(654): Xaa at position 654 is Ile, Ala, Val, Leu, or Gly
  SITE (657)..(657): Xaa at position 657 is Ala, Gly, or Pro
  SITE (658)..(658): Xaa at position 658 is Leu, Ala, Val, Gly, or Ile
  SITE (660)..(660): Xaa at position 660 is Leu, Ala, Val, Gly, or Ile
  SITE (663)..(663): Xaa at position 663 is Tyr, Phe, Met, His, Ile, Leu, Val Ala, or Gly
  SITE (664)..(664): Xaa at position 664 is Leu, Ala, Val, Gly, or Ile
  SITE (673)..(673): Xaa at position 673 is Val, Ala, Gly, Leu, or Ile
  SITE (680)..(680): Xaa at position 680 is Leu, Ala, Val, Gly, or Ile
  SITE (687)..(687): Xaa at position 687 is Met, Ile, Leu, Val, Ala, or Gly
  SITE (695)..(695): Xaa at position 695 is Val, Ala, Gly, Leu, or Ile
  SITE (699)..(699): Xaa at position 699 is Phe, Tyr, Met, His, Ile, Leu, Val Ala, or Gly
  SITE (702)..(702): Xaa at position 702 is Phe, Tyr, Met, His, Ile, Leu, Val Ala, or Gly
  SITE (703)..(703): Xaa at position 703 is Leu, Ala, Val, Gly, or Ile
  SITE (731)..(731): Xaa at position 731 is Leu, Ala, Val, Gly, or Ile
  SITE (732)..(732): Xaa at position 732 is Leu, Ala, Val, Gly, or Ile
  SITE (735)..(735): Xaa at position 735 is Ala, Gly, or Pro
  SITE (743)..(743): Xaa at position 743 is Cys, Ala, Val, Gly, Ser, or Thr
  SITE (747)..(747): Xaa at position 747 is Ala, Gly, or Pro
  SITE (767)..(767): Xaa at position 767 is Val, Ala, Gly, Leu, or Ile
  SITE (770)..(770): Xaa at position 770 is Ala, Gly, or Pro
  SITE (771)..(771): Xaa at position 771 is Val, Ala, Gly, Leu, or Ile
  SITE (776)..(776): Xaa at position 776 is Ala, Gly, or Pro
  SITE (782)..(782): Xaa at position 782 is Trp, Tyr, Phe, Met, His, Ile, Leu Val, Ala, or Gly
  SITE (785)..(785): Xaa at position 785 is Leu, Ala, Val, Gly, or Ile
  SITE (801)..(801): Xaa at position 801 is Ile, Ala, Val, Leu, or Gly
  SITE (804)..(804): Xaa at position 804 is Ala, Gly, or Pro
  SITE (805)..(805): Xaa at position 805 is Leu, Ala, Val, Gly, or Ile
  SITE (806)..(806): Xaa at position 806 is Cys, Ala, Val, Gly, Ser, or Thr
  SITE (814)..(814): Xaa at position 814 is Leu, Ala, Val, Gly, or Ile
  SITE (817)..(817): Xaa at position 817 is Leu, Ala, Val, Gly, or Ile
  SITE (818)..(818): Xaa at position 818 is Leu, Ala, Val, Gly, or Ile
  SITE (827)..(827): Xaa at position 827 is Ile, Ala, Val, Leu, or Gly
  SITE (832)..(832): Xaa at position 832 is Phe, Tyr, Met, His, Ile, Leu, Val Ala, or Gly
  SITE (835)..(835): Xaa at position 835 is Ile, Ala, Val, Leu, or Gly
  SITE (836)..(836): Xaa at position 836 is Leu, Ala, Val, Gly, or Ile
  SITE (839)..(839): Xaa at position 839 is Ile, Ala, Val, Leu, or Gly
  SITE (849)..(849): Xaa at position 849 is Ala, Gly, or Pro
  SITE (850)..(850): Xaa at position 850 is Trp, Tyr, Phe, Met, His, Ile, Leu Val, Ala, or Gly
  SITE (853)..(853): Xaa at position 853 is Leu, Ala, Val, Gly, or Ile
  SITE (860)..(860): Xaa at position 860 is Leu, Ala, Val, Gly, or Ile
  SITE (864)..(864): Xaa at position 864 is Phe, Tyr, Met, His, Ile, Leu, Val Ala, or Gly
  SITE (871)..(871): Xaa at position 871 is Ile, Ala, Val, Leu, or Gly
  SITE (874)..(874): Xaa at position 874 is Met, Ile, Leu, Val, Ala, or Gly
  SITE (875)..(875): Xaa at position 875 is Val, Ala, Gly, Leu, or Ile
  SITE (882)..(882): Xaa at position 882 is Phe, Tyr, Met, His, Ile, Leu, Val Ala, or Gly
  SITE (891)..(891): Xaa at position 891 is Val, Ala, Gly, Leu, or Ile
  SITE (895)..(895): Xaa at position 895 is Phe, Tyr, Met, His, Ile, Leu, Val Ala, or Gly
  SITE (898)..(898): Xaa at position 898 is Leu, Ala, Val, Gly, or Ile
  SITE (905)..(905): Xaa at position 905 is Leu, Ala, Val, Gly, or Ile
  SITE (915)..(915): Xaa at position 915 is Ile, Ala, Val, Leu, or Gly
  SITE (929)..(929): Xaa at position 929 is Ile, Ala, Val, Leu, or Gly
  SITE (933)..(933): Xaa at position 933 is Leu, Ala, Val, Gly, or Ile
MVFLPLKWSLATMSFLLSSLLALLTVSTPSWCQSTEASPKRSDGTPXPWNKIRLPEXVIPVHXDXLXHANXTTLTXWGTTKXEXTXSQPTSTXXXHSHHLQISRXTXRKGAGERXSEEPLQVXEHPRQEQXXXLAPEPXXXGLPXTXXXHXAGNLSETFHGFXKSTYRTKEGELRIXXSTQXEPTXXRMXXPXXDEPAFKXSXSXKXRREPRHLAISNMPLVKSVTVAEGLIEDHXDVTVKXSTXXXXXXXSDFESVSKITKSGVKXSXYXVPDKINQXDXXXDXXVTXXEFXEDYXSIPYPLPKQDXXXXPDXQSGXXENXGXTTXRESXXXFDAEKSSASSKLGXTMTXXHEXXXQXXGNXVTXEWXNDXXXNEGXXKXXEFVSXSVTHPEXKXGDYFFGKCXDXXEVDXLNSSHPXSTPXENPAQIREXFDDXSYDKGXXXXNMXREYLSADAXKSGXVQYXQKHSYKNTKNEDXXDSXASICPTDGVKGMDGFCSRSQHSSSSSHWHQEGVDXKTXXNTXTLQKGXPXXTXTVRGRNXHXKQEHXMKGSDGAPDTGYLXHXPXTFITSKSDMVHRFLXKTKTDVLILPEEVEWIKXNVGXNGXXXXHYEDDGWDSXTGLXKGTHTAXSSNDRXSXXNNXFQXVSIGKLSXEKXXDXSLXXKHETEIMPXFQGLNEXIPMYKLXEKRDMNEXETQXKAXXIRLLRDLIDKQTWTDEGSVSERMLRSQXXLLXCVHNYQPXVQRXEGYFRKWKESNGNLSLPVDXTLXXFAVGXQSTEGXDFXYSKYQFSLSSTEKSQXEFXXXRTQNKEKXQWXXDESFKGDKXKTQEXPQXXTLXGRNPVGYPLXXQFXRKNWNKXVQKXELGSSSXAHXXMGTTNQXSTRTRLEEXKGFXSSXKENGSQXRCVQQTIETXEENIGWMDKNFDKXRVWXQSEKLERM

SEQ ID NO: 880 - protein, 696 aa, Homo sapiens
  SITE (66)..(66): Xaa at position 66 is Leu, Ala, Val, Gly, or Ile
  SITE (347)..(347): Xaa at position 347 is Val, Ala, Gly, Leu, or Ile
MKAPIPHLILLYATFTQSLKVVTKRGSADGCTDWSIDIKKYQVLVGEPVRIKCALFYGYIRTNYSXAQSAGLSLMWYKSSGPGDFEEPIAFDGSRMSKEEDSIWFRPTLLQDSGLYACVIRNSTYCMKVSISLTVGENDTGLCYNSKMKYFEKAELSKSKEISCRDIEDFLLPTREPEILWYKECRTKTWRPSIVFKRDTLLIREVREDDIGNYTCELKYGGFVVRRTTELTVTAPLTDKPPKLLYPMESKLTIQETQLGDSANLTCRAFFGYSGDVSPLIYWMKGEKFIEDLDENRVWESDIRILKEHLGEQEVSISLIVDSVEEGDLGNYSCYVENGNGRRHASXLLHKRELMYTVELAGGLGAILLLLVCLVTIYKCYKIEIMLFYRNHFGAEELDGDNKDYDAYLSYTKVDPDQWNQETGEEERFALEILPDMLEKHYGYKLFIPDRDLIPTGTYIEDVARCVDQSKRLIIVMTPNYVVRRGWSIFELETRLRNMLVTGEIKVILIECSELRGIMNYQEVEALKHTIKLLTVIKWHGPKCNKLNSKFWKRLQYEMPFKRIEPITHEQALDVSEQGPFGELQTVSAISMAAATSTALATAHPDLRSTFHNTYHSQMRQKHYYRSYEYDVPPTGTLPLTSIGNQHTYCNIPMTLINGQRPQTKSSREQNPDEAHTNSAILPLLPRETSISSVIW

SEQ ID NO: 881 - protein, 290 aa, Homo sapiens
  SITE (21)..(21): Xaa at position 21 is Val, Ala, Gly, Leu, or Ile
  SITE (36)..(36): Xaa at position 36 is Met, Ile, Leu, Val, Ala, or Gly
  SITE (38)..(38): Xaa at position 38 is Ile, Ala, Val, Leu, or Gly
  SITE (40)..(40): Xaa at position 40 is Cys, Ala, Val, Gly, Ser, or Thr
  SITE (53)..(53): Xaa at position 53 is Leu, Ala, Val, Gly, or Ile
  SITE (55)..(55): Xaa at position 55 is Val, Ala, Gly, Leu, or Ile
  SITE (57)..(57): Xaa at position 57 is Trp, Tyr, Phe, Met, His, Ile, Leu Val, Ala, or Gly
  SITE (59)..(59): Xaa at position 59 is Met, Ile, Leu, Val, Ala, or Gly
  SITE (64)..(64): Xaa at position 64 is Ile, Ala, Val, Leu, or Gly
  SITE (65)..(65): Xaa at position 65 is Ile, Ala, Val, Leu, or Gly
  SITE (67)..(67): Xaa at position 67 is Phe, Tyr, Met, His, Ile, Leu, Val Ala, or Gly
  SITE (81)..(81): Xaa at position 81 is Tyr, Phe, Met, His, Ile, Leu, Val Ala, or Gly
  SITE (92)..(92): Xaa at position 92 is Leu, Ala, Val, Gly, or Ile
  SITE (97)..(97): Xaa at position 97 is Ala, Gly, or Pro
  SITE (98)..(98): Xaa at position 98 is Ala, Gly, or Pro
  SITE (99)..(99): Xaa at position 99 is Leu, Ala, Val, Gly, or Ile
  SITE (101)..(101): Xaa at position 101 is Ile, Ala, Val, Leu, or Gly
  SITE (104)..(104): Xaa at position 104 is Val, Ala, Gly, Leu, or Ile
  SITE (112)..(112): Xaa at position 112 is Tyr, Phe, Met, His, Ile, Leu, Val Ala, or Gly
  SITE (114)..(114): Xaa at position 114 is Cys, Ala, Val, Gly, Ser, or Thr
  SITE (116)..(116): Xaa at position 116 is Ile, Ala, Val, Leu, or Gly
  SITE (126)..(126): Xaa at position 126 is Ile, Ala, Val, Leu, or Gly
  SITE (128)..(128): Xaa at position 128 is Val, Ala, Gly, Leu, or Ile
  SITE (132)..(132): Xaa at position 132 is Ala, Gly, or Pro
  SITE (134)..(134): Xaa at position 134 is Tyr, Phe, Met, His, Ile, Leu, Val Ala, or Gly
  SITE (153)..(153): Xaa at position 153 is Leu, Ala, Val, Gly, or Ile
  SITE (155)..(155): Xaa at position 155 is Cys, Ala, Val, Gly, Ser, or Thr
  SITE (157)..(157): Xaa at position 157 is Ala, Gly, or Pro
  SITE (163)..(163): Xaa at position 163 is Ala, Gly, or Pro
  SITE (167)..(167): Xaa at position 167 is Trp, Tyr, Phe, Met, His, Ile, Leu Val, Ala, or Gly
  SITE (193)..(193): Xaa at position 193 is Val, Ala, Gly, Leu, or Ile
  SITE (197)..(197): Xaa at position 197 is Leu, Ala, Val, Gly, or Ile
  SITE (207)..(207): Xaa at position 207 is Phe, Tyr, Met, His, Ile, Leu, Val Ala, or Gly
  SITE (209)..(209): Xaa at position 209 is Cys, Ala, Val, Gly, Ser, or Thr
  SITE (211)..(211): Xaa at position 211 is Phe, Tyr, Met, His, Ile, Leu, Val Ala, or Gly
  SITE (214)..(214): Xaa at position 214 is Leu, Ala, Val, Gly, or Ile
  SITE (224)..(224): Xaa at position 224 is Leu, Ala, Val, Gly, or Ile
  SITE (226)..(226): Xaa at position 226 is Ile, Ala, Val, Leu, or Gly
MRIFAVFIFMTYWHLLNAFTXTVPKDLYVVEYGSNXTXEXKFPVEKQLDLAAXIXYXEXEDKNXXQXVHGEEDLKVQHSSXRQRARLLKDQXSLGNXXXQXTDXKLQDAGVXRXMXSYGGADYKRXTXKVNXPXNKINQRILVVDPVTSEHEXTXQXEGYPKXEVIXTSSDHQVLSGKTTTTNSKREEKLFNXTSTXRINTTTNEIXYXTXRRXDPEENHTAEXVXPELPLAHPPNERTHLVILGAILLCLGVALTFIFRLRKGRMMDVKKCGIQDTNSKKQSDTHLEET

SEQ ID NO: 882 - protein, 630 aa, Homo sapiens
  SITE (66)..(66): Xaa at position 66 is Leu, Ala, Val, Gly, or Ile
  SITE (84)..(84): Xaa at position 84 is Phe, Tyr, Met, His, Ile, Leu, Val Ala, or Gly
MAAGVAAWLPFARAAAIGWMPVASGPMPAPPRQERKRTQDALIVLNVSGTRFQTWQDTLERYPDTXLGSSERDFFYHPETQQYXFDRDPDIFRHILNFYRTGKLHYPRHECISAYDEELAFFGLIPEIIGDCCYEEYKDRRRENAERLQDDADTDTAGESALPTMTARQRVWRAFENPHTSTMALVFYYVTGFFIAVSVIANVVETVPCGSSPGHIKELPCGERYAVAFFCLDTACVMIFTVEYLLRLAAAPSRYRFVRSVMSIIDVVAILPYYIGLVMTDNEDVSGAFVTLRVFRVFRIFKFSRHSQGLRILGYTLKSCASELGFLLFSLTMAIIIFATVMFYAEKGSSASKFTSIPAAFWYTIVTMTTLGYGDMVPKTIAGKIFGSICSLSGVLVIALPVPVIVSNFSRIYHQNQRADKRRAQKKARLARIRAAKSGSANAYMQSKRNGLLSNQLQSSEDEQAFVSKSGSSFETQHHHLLHCLEKTTNHEFVDEQVFEESCMEVATVNRPSSHSPSLSSQQGVTSTCCSRRHKKTFRIPNANVSGSHQGSIQELSTIQIRCVERTPLSNSRSSLNAKMEECVKLNCEQPYVTTAIISIPTPPVTTPEGDDRPESPEYSGGNIVRVSAL

SEQ ID NO: 883 - protein, 387 aa, Homo sapiens
  SITE (49)..(49): Xaa at position 49 is Ala, Gly, or Pro
  SITE (51)..(51): Xaa at position 51 is Leu, Ala, Val, Gly, or Ile
  SITE (53)..(53): Xaa at position 53 is Cys, Ala, Val, Gly, Ser, or Thr
  SITE (64)..(64): Xaa at position 64 is Val, Ala, Gly, Leu, or Ile
  SITE (66)..(66): Xaa at position 66 is Trp, Tyr, Phe, Met, His, Ile, Leu Val, Ala, or Gly
  SITE (104)..(104): Xaa at position 104 is Ile, Ala, Val, Leu, or Gly
  SITE (109)..(109): Xaa at position 109 is Ile, Ala, Val, Leu, or Gly
  SITE (119)..(119): Xaa at position 119 is Cys, Ala, Val, Gly, Ser, or Thr
  SITE (120)..(120): Xaa at position 120 is Val, Ala, Gly, Leu, or Ile
  SITE (166)..(166): Xaa at position 166 is Phe, Tyr, Met, His, Ile, Leu, Val Ala, or Gly
  SITE (168)..(168): Xaa at position 168 is Cys, Ala, Val, Gly, Ser, or Thr
  SITE (173)..(173): Xaa at position 173 is Phe, Tyr, Met, His, Ile, Leu, Val Ala, or Gly
  SITE (182)..(182): Xaa at position 182 is Trp, Tyr, Phe, Met, His, Ile, Leu Val, Ala, or Gly
  SITE (211)..(211): Xaa at position 211 is Ala, Gly, or Pro
  SITE (213)..(213): Xaa at position 213 is Val, Ala, Gly, Leu, or Ile
  SITE (215)..(215): Xaa at position 215 is Leu, Ala, Val, Gly, or Ile
  SITE (224)..(224): Xaa at position 224 is Val, Ala, Gly, Leu, or Ile
  SITE (226)..(226): Xaa at position 226 is Cys, Ala, Val, Gly, Ser, or Thr
  SITE (228)..(228): Xaa at position 228 is Val, Ala, Gly, Leu, or Ile
  SITE (244)..(244): Xaa at position 244 is Leu, Ala, Val, Gly, or Ile
  SITE (247)..(247): Xaa at position 247 is Ala, Gly, or Pro
  SITE (248)..(248): Xaa at position 248 is Ile, Ala, Val, Leu, or Gly
  SITE (269)..(269): Xaa at position 269 is Val, Ala, Gly, Leu, or Ile
  SITE (271)..(271): Xaa at position 271 is Cys, Ala, Val, Gly, Ser, or Thr
  SITE (273)..(273): Xaa at position 273 is Val, Ala, Gly, Leu, or Ile
  SITE (276)..(276): Xaa at position 276 is Phe, Tyr, Met, His, Ile, Leu, Val Ala, or Gly
  SITE (283)..(283): Xaa at position 283 is Leu, Ala, Val, Gly, or Ile
  SITE (285)..(285): Xaa at position 285 is Trp, Tyr, Phe, Met, His, Ile, Leu Val, Ala, or Gly
  SITE (329)..(329): Xaa at position 329 is Cys, Ala, Val, Gly, Ser, or Thr
  SITE (331)..(331): Xaa at position 331 is Val, Ala, Gly, Leu, or Ile
MPVPASWPHPPGPFLLLTLLLGLTEVAGEEELQMIQPEKLLLVTVGKTXTXHXTVTSLLPVGPXLXFRGVGPGRELIYNQKEGHFPRVTTVSDLTKRNNMDFSXRISSXTPADVGTYYXXKFRKGSPENVEFKSGPGTEMALGAKPSAPVVLGPAARTTPEHTVSXTXESHGXSPRDITLKXFKNGNELSDFQTNVDPTGQSVAYSIRSTXRXVXDPWDVRSQXIXEXAHVTLQGDPLRGTANXSEXXRVPPTLEVTQQPMRVGNQVNXTXQXRKXYPQSLQXTXSENGNVCQRETASTLTENKDGTYNWTSWFLVNISDQRDDVVLTXQXKHDGQLAVSKRLALEVTVHQKDQSSDATPGPASSLTALLLIAVLLGPIYVPWKQKT

SEQ ID NO: 884 - protein, 616 aa, Homo sapiens
  SITE (116)..(116): Xaa at position 116 is Val, Ala, Gly, Leu, or Ile
  SITE (123)..(123): Xaa at position 123 is Ala, Gly, or Pro
  SITE (130)..(130): Xaa at position 130 is Ala, Gly, or Pro
  SITE (145)..(145): Xaa at position 145 is Ala, Gly, or Pro
MNSPGGRGKKKGSGGASNPVPPRPPPPCLAPAPPAAGPAPPPESPHKRNLYYFSYPLFVGFALLRLVAFHLGLLFVWLCQRFSRALMAAKRSSGAAPAPASASAPAPVPGGEAERXRVFHKQXFEYISIXLRIDEDEKAGQKEQXVEWYKKGIEELEKGIAVIVTGQGEQCERARRLQAKMMTNLVMAKDRLQLLEKMQPVLPFSKSQTDVYNDSTNLACRNGHLQSESGAVPKRKDPLTHTSNSLPRSKTVMKTGSAGLSGHHRAPSYSGLSMVSGVKQGSGPAPTTHKGTPKTNRTNKPSTPTTATRKKKDLKNFRNVDSNLANLIMNEIVDNGTAVKFDDIAGQDLAKQALQEIVILPSLRPELFTGLRAPARGLLLFGPPGNGKTMLAKAVAAESNATFFNISAASLTSKYVGEGEKLVRALFAVARELQPSIIFIDEVDSLLCERREGEHDASRRLKTEFLIEFDGVQSAGDDRVLVMGATNRPQELDEAVLRRFIKRVYVSLPNEETRLLLLKNLLCKQGSPLTQKELAQLARMTDGYSGSDLTALAKDAALGPIRELKPEQVKNMSASEMRNIRLSDFTESLKKIKRSVSPQTLEAYIRWNKDFGDTTV

SEQ ID NO: 885 - protein, 328 aa, Homo sapiens
  SITE (9)..(9): Xaa at position 9 is Val, Ala, Gly, Leu, or Ile
  SITE (11)..(11): Xaa at position 11 is Val, Ala, Gly, Leu, or Ile
  SITE (23)..(23): Xaa at position 23 is Leu, Ala, Val, Gly, or Ile
  SITE (24)..(24): Xaa at position 24 is Ala, Gly, or Pro
  SITE (26)..(26): Xaa at position 26 is Ala, Gly, or Pro
  SITE (49)..(49): Xaa at position 49 is Val, Ala, Gly, Leu, or Ile
  SITE (50)..(50): Xaa at position 50 is Ala, Gly, or Pro
  SITE (52)..(52): Xaa at position 52 is Ala, Gly, or Pro
  SITE (55)..(55): Xaa at position 55 is Leu, Ala, Val, Gly, or Ile
  SITE (56)..(56): Xaa at position 56 is Leu, Ala, Val, Gly, or Ile
  SITE (57)..(57): Xaa at position 57 is Cys, Ala, Val, Gly, Ser, or Thr
  SITE (63)..(63): Xaa at position 63 is Val, Ala, Gly, Leu, or Ile
  SITE (68)..(68): Xaa at position 68 is Leu, Ala, Val, Gly, or Ile
  SITE (77)..(77): Xaa at position 77 is Val, Ala, Gly, Leu, or Ile
  SITE (78)..(78): Xaa at position 78 is Ile, Ala, Val, Leu, or Gly
  SITE (93)..(93): Xaa at position 93 is Ile, Ala, Val, Leu, or Gly
  SITE (112)..(112): Xaa at position 112 is Ala, Gly, or Pro
  SITE (115)..(115): Xaa at position 115 is Ala, Gly, or Pro
  SITE (118)..(118): Xaa at position 118 is Leu, Ala, Val, Gly, or Ile
  SITE (119)..(119): Xaa at position 119 is Leu, Ala, Val, Gly, or Ile
  SITE (123)..(123): Xaa at position 123 is Cys, Ala, Val, Gly, Ser, or Thr
  SITE (156)..(156): Xaa at position 156 is Val, Ala, Gly, Leu, or Ile
  SITE (158)..(158): Xaa at position 158 is Ile, Ala, Val, Leu, or Gly
  SITE (167)..(167): Xaa at position 167 is Ala, Gly, or Pro
  SITE (168)..(168): Xaa at position 168 is Ile, Ala, Val, Leu, or Gly
  SITE (169)..(169): Xaa at position 169 is Ala, Gly, or Pro
  SITE (172)..(172): Xaa at position 172 is Leu, Ala, Val, Gly, or Ile
  SITE (181)..(181): Xaa at position 181 is Leu, Ala, Val, Gly, or Ile
  SITE (192)..(192): Xaa at position 192 is Ala, Gly, or Pro
  SITE (205)..(205): Xaa at position 205 is Leu, Ala, Val, Gly, or Ile
  SITE (206)..(206): Xaa at position 206 is Ala, Gly, or Pro
  SITE (211)..(211): Xaa at position 211 is Phe, Tyr, Met, His, Ile, Leu, Val Ala, or Gly
  SITE (212)..(212): Xaa at position 212 is Ile, Ala, Val, Leu, or Gly
  SITE (213)..(213): Xaa at position 213 is Val, Ala, Gly, Leu, or Ile
  SITE (214)..(214): Xaa at position 214 is Val, Ala, Gly, Leu, or Ile
  SITE (226)..(226): Xaa at position 226 is Cys, Ala, Val, Gly, Ser, or Thr
  SITE (230)..(230): Xaa at position 230 is Phe, Tyr, Met, His, Ile, Leu, Val Ala, or Gly
  SITE (231)..(231): Xaa at position 231 is Phe, Tyr, Met, His, Ile, Leu, Val Ala, or Gly
  SITE (238)..(238): Xaa at position 238 is Ala, Gly, or Pro
  SITE (239)..(239): Xaa at position 239 is Val, Ala, Gly, Leu, or Ile
  SITE (240)..(240): Xaa at position 240 is Phe, Tyr, Met, His, Ile, Leu, Val Ala, or Gly
  SITE (241)..(241): Xaa at position 241 is Ile, Ala, Val, Leu, or Gly
  SITE (248)..(248): Xaa at position 248 is Val, Ala, Gly, Leu, or Ile
  SITE (254)..(254): Xaa at position 254 is Leu, Ala, Val, Gly, or Ile
  SITE (257)..(257): Xaa at position 257 is Ala, Gly, or Pro
  SITE (264)..(264): Xaa at position 264 is Ala, Gly, or Pro
  SITE (266)..(266): Xaa at position 266 is Ala, Gly, or Pro
  SITE (268)..(268): Xaa at position 268 is Leu, Ala, Val, Gly, or Ile
  SITE (270)..(270): Xaa at position 270 is Val, Ala, Gly, Leu, or Ile
  SITE (282)..(282): Xaa at position 282 is Leu, Ala, Val, Gly, or Ile
  SITE (309)..(309): Xaa at position 309 is Ala, Gly, or Pro
  SITE (310)..(310): Xaa at position 310 is Ala, Gly, or Pro
  SITE (313)..(313): Xaa at position 313 is Leu, Ala, Val, Gly, or Ile
MRPVRLMKXFXTRRIPAEGRVAXXRXADCEVEQWDSDEPIPAKELERGXXGXHGXXXLLSDHXDKRIXDAAGANLKXXSTMSVGIDHLALDEXKKRGIRVGYTPDVLTDTTXELXVSXXLTTXRRLPEAIEEVKNGGWTSWKPLWLCGYGLTQSTXGXIGLGRIGQXXXRRXKPFGVQRFXYTGRQPRPEEXAEFQAEFVSTPEXXAQSDXXXXACSLTPATEGLXNKDXXQKMKETXXXXNISRGDXVNQDDXYQXLASGKIXAXGXDXTSPEPLPTNHPXLTLKNCVILPHIGSATHRTRNTMSLLXXNNXLAGLRGEPMPSELKL

SEQ ID NO: 886 - protein, 327 aa, Homo sapiens
  SITE (95)..(95): Xaa at position 95 is Leu, Ala, Val, Gly, or Ile
  SITE (96)..(96): Xaa at position 96 is Ala, Gly, or Pro
  SITE (97)..(97): Xaa at position 97 is Val, Ala, Gly, Leu, or Ile
  SITE (98)..(98): Xaa at position 98 is Leu, Ala, Val, Gly, or Ile
  SITE (99)..(99): Xaa at position 99 is Val, Ala, Gly, Leu, or Ile
  SITE (111)..(111): Xaa at position 111 is Phe, Tyr, Met, His, Ile, Leu, Val Ala, or Gly
  SITE (112)..(112): Xaa at position 112 is Val, Ala, Gly, Leu, or Ile
  SITE (115)..(115): Xaa at position 115 is Met, Ile, Leu, Val, Ala, or Gly
  SITE (119)..(119): Xaa at position 119 is Leu, Ala, Val, Gly, or Ile
  SITE (128)..(128): Xaa at position 128 is Ile, Ala, Val, Leu, or Gly
  SITE (130)..(130): Xaa at position 130 is Val, Ala, Gly, Leu, or Ile
  SITE (131)..(131): Xaa at position 131 is Leu, Ala, Val, Gly, or Ile
  SITE (142)..(142): Xaa at position 142 is Ala, Gly, or Pro
  SITE (144)..(144): Xaa at position 144 is Leu, Ala, Val, Gly, or Ile
  SITE (145)..(145): Xaa at position 145 is Ile, Ala, Val, Leu, or Gly
  SITE (147)..(147): Xaa at position 147 is Val, Ala, Gly, Leu, or Ile
  SITE (159)..(159): Xaa at position 159 is Ile, Ala, Val, Leu, or Gly
  SITE (160)..(160): Xaa at position 160 is Ala, Gly, or Pro
  SITE (162)..(162): Xaa at position 162 is His, Phe, Tyr, Lys, Arg, Gly, Ser Thr, Ala, Val, Leu, Ile, Asn, Met, or Gln
  SITE (166)..(166): Xaa at position 166 is Leu, Ala, Val, Gly, or Ile
  SITE (167)..(167): Xaa at position 167 is Leu, Ala, Val, Gly, or Ile
  SITE (173)..(173): Xaa at position 173 is Leu, Ala, Val, Gly, or Ile
  SITE (175)..(175): Xaa at position 175 is Tyr, Phe, Met, His, Ile, Leu, Val Ala, or Gly
  SITE (184)..(184): Xaa at position 184 is His, Phe, Tyr, Lys, Arg, Gly, Ser Thr, Ala, Val, Leu, Ile, Asn, Met, or Gln
  SITE (185)..(185): Xaa at position 185 is Val, Ala, Gly, Leu, or Ile
  SITE (186)..(186): Xaa at position 186 is Ala, Gly, or Pro
  SITE (190)..(190): Xaa at position 190 is Leu, Ala, Val, Gly, or Ile
  SITE (200)..(200): Xaa at position 200 is Val, Ala, Gly, Leu, or Ile
  SITE (203)..(203): Xaa at position 203 is Ile, Ala, Val, Leu, or Gly
  SITE (204)..(204): Xaa at position 204 is Leu, Ala, Val, Gly, or Ile
  SITE (205)..(205): Xaa at position 205 is Leu, Ala, Val, Gly, or Ile
  SITE (206)..(206): Xaa at position 206 is Leu, Ala, Val, Gly, or Ile
  SITE (211)..(211): Xaa at position 211 is Tyr, Phe, Met, His, Ile, Leu, Val Ala, or Gly
  SITE (217)..(217): Xaa at position 217 is Met, Ile, Leu, Val, Ala, or Gly
  SITE (231)..(231): Xaa at position 231 is Phe, Tyr, Met, His, Ile, Leu, Val Ala, or Gly
  SITE (235)..(235): Xaa at position 235 is Ile, Ala, Val, Leu, or Gly
  SITE (242)..(242): Xaa at position 242 is Leu, Ala, Val, Gly, or Ile
  SITE (258)..(258): Xaa at position 258 is Leu, Ala, Val, Gly, or Ile
  SITE (262)..(262): Xaa at position 262 is Ala, Gly, or Pro
  SITE (305)..(305): Xaa at position 305 is Ala, Gly, or Pro
  SITE (310)..(310): Xaa at position 310 is Leu, Ala, Val, Gly, or Ile
  SITE (312)..(312): Xaa at position 312 is Ile, Ala, Val, Leu, or Gly
  SITE (324)..(324): Xaa at position 324 is Cys, Ala, Val, Gly, Ser, or Thr
MFPSRRKAAQLPWEDGRSGLLSGGLPRKCSVFHLFVACLSLGFFSLLWLQLSCSGDVARAVRGQGQETSGPPRACPPEPPPEHWEEDASWGPHRXXXXXPFRERFEELLVXXPHXRRFXSRKKIRHHXYXXNQVDHFRFNRXAXXNXGFLESSNSTDYXXMXDVDXXPLNEEXDXGFPEAGPFXXXSPEXHPLYHYKTYXGGXXXXSKQHXRLCNGXSNRFWGWGREDDEXYRRXKGAGLQXFRPSGITTGYKTFRHXHDPXWRKRDQKRIAAQKQEQFKVDREGGLNTVKYHVASRTALSVGGXPCTVXNXMLDCDKTATPWXTFS

SEQ ID NO: 887 - protein, 448 aa, Homo sapiens
  SITE (166)..(166): Xaa at position 166 is Cys, Ala, Val, Gly, Ser, or Thr
  SITE (286)..(286): Xaa at position 286 is Cys, Ala, Val, Gly, Ser, or Thr
MPGIKRILTVTILALCLPSPGNAQAQCTNGFDLDRQSGQCLDIDECRTIPEACRGDMMCVNQNGGYLCIPRTNPVYRGPYSNPYSTPYSGPYPAAAPPLSAPNYPTISRPLICRFGYQMDESNQCVDVDECATDSHQCNPTQICINTEGGYTCSCTDGYWLLEGQXLDIDECRYGYCQQLCANVPGSYSCTCNPGFTLNEDGRSCQDVNECATENPCVQTCVNTYGSFICRCDPGYELEEDGVHCSDMDECSFSEFLCQHECVNQPGTYFCSCPPGYILLDDNRSXQDINECEHRNHTCNLQQTCYNLQGGFKCIDPIRCEEPYLRISDNRCMCPAENPGCRDQPFTILYRDMDVVSGRSVPADIFQMQATTRYPGAYYIFQIKSGNEGREFYMRQTGPISATLVMTRPIKGPREIQLDLEMITVNTVINFRGSSVIRLRIYVSQYPF

SEQ ID NO: 888 - protein, 569 aa, Homo sapiens
  SITE (265)..(265): Xaa at position 265 is Met, Ile, Leu, Val, Ala, or Gly
  SITE (270)..(270): Xaa at position 270 is Cys, Ala, Val, Gly, Ser, or Thr
  SITE (273)..(273): Xaa at position 273 is Ile, Ala, Val, Leu, or Gly
  SITE (289)..(289): Xaa at position 289 is Val, Ala, Gly, Leu, or Ile
  SITE (292)..(292): Xaa at position 292 is Ala, Gly, or Pro
  SITE (296)..(296): Xaa at position 296 is Leu, Ala, Val, Gly, or Ile
  SITE (304)..(304): Xaa at position 304 is Ala, Gly, or Pro
  SITE (306)..(306): Xaa at position 306 is Leu, Ala, Val, Gly, or Ile
  SITE (318)..(318): Xaa at position 318 is Leu, Ala, Val, Gly, or Ile
  SITE (320)..(320): Xaa at position 320 is Ile, Ala, Val, Leu, or Gly
  SITE (323)..(323): Xaa at position 323 is Phe, Tyr, Met, His, Ile, Leu, Val Ala, or Gly
  SITE (324)..(324): Xaa at position 324 is Ile, Ala, Val, Leu, or Gly
  SITE (326)..(326): Xaa at position 326 is Ile, Ala, Val, Leu, or Gly
  SITE (327)..(327): Xaa at position 327 is Leu, Ala, Val, Gly, or Ile
  SITE (341)..(341): Xaa at position 341 is Leu, Ala, Val, Gly, or Ile
  SITE (346)..(346): Xaa at position 346 is Ile, Ala, Val, Leu, or Gly
  SITE (368)..(368): Xaa at position 368 is Ala, Gly, or Pro
  SITE (370)..(370): Xaa at position 370 is Leu, Ala, Val, Gly, or Ile
  SITE (373)..(373): Xaa at position 373 is Ala, Gly, or Pro
  SITE (374)..(374): Xaa at position 374 is Val, Ala, Gly, Leu, or Ile
  SITE (377)..(377): Xaa at position 377 is Leu, Ala, Val, Gly, or Ile
  SITE (385)..(385): Xaa at position 385 is Leu, Ala, Val, Gly, or Ile
  SITE (387)..(387): Xaa at position 387 is Val, Ala, Gly, Leu, or Ile
  SITE (399)..(399): Xaa at position 399 is Leu, Ala, Val, Gly, or Ile
  SITE (401)..(401): Xaa at position 401 is His, Phe, Tyr, Lys, Arg, Gly, Ser Thr, Ala, Val, Leu, Ile, Asn, Met, or Gln
  SITE (404)..(404): Xaa at position 404 is Ile, Ala, Val, Leu, or Gly
  SITE (405)..(405): Xaa at position 405 is Leu, Ala, Val, Gly, or Ile
  SITE (408)..(408): Xaa at position 408 is Leu, Ala, Val, Gly, or Ile
  SITE (420)..(420): Xaa at position 420 is Phe, Tyr, Met, His, Ile, Leu, Val Ala, or Gly
  SITE (425)..(425): Xaa at position 425 is Leu, Ala, Val, Gly, or Ile
  SITE (430)..(430): Xaa at position 430 is Ile, Ala, Val, Leu, or Gly
  SITE (445)..(445): Xaa at position 445 is Ile, Ala, Val, Leu, or Gly
  SITE (448)..(448): Xaa at position 448 is Ala, Gly, or Pro
  SITE (449)..(449): Xaa at position 449 is Leu, Ala, Val, Gly, or Ile
  SITE (457)..(457): Xaa at position 457 is Ile, Ala, Val, Leu, or Gly
  SITE (460)..(460): Xaa at position 460 is Leu, Ala, Val, Gly, or Ile
  SITE (462)..(462): Xaa at position 462 is Val, Ala, Gly, Leu, or Ile
  SITE (473)..(473): Xaa at position 473 is Tyr, Phe, Met, His, Ile, Leu, Val Ala, or Gly
  SITE (478)..(478): Xaa at position 478 is Val, Ala, Gly, Leu, or Ile
  SITE (482)..(482): Xaa at position 482 is Ala, Gly, or Pro
  SITE (490)..(490): Xaa at position 490 is Leu, Ala, Val, Gly, or Ile
  SITE (494)..(494): Xaa at position 494 is Val, Ala, Gly, Leu, or Ile
  SITE (498)..(498): Xaa at position 498 is Leu, Ala, Val, Gly, or Ile
  SITE (511)..(511): Xaa at position 511 is Cys, Ala, Val, Gly, Ser, or Thr
  SITE (517)..(517): Xaa at position 517 is Leu, Ala, Val, Gly, or Ile
  SITE (520)..(520): Xaa at position 520 is Ile, Ala, Val, Leu, or Gly
  SITE (529)..(529): Xaa at position 529 is Val, Ala, Gly, Leu, or Ile
  SITE (532)..(532): Xaa at position 532 is Leu, Ala, Val, Gly, or Ile
  SITE (533)..(533): Xaa at position 533 is Val, Ala, Gly, Leu, or Ile
  SITE (534)..(534): Xaa at position 534 is Val, Ala, Gly, Leu, or Ile
  SITE (535)..(535): Xaa at position 535 is Val, Ala, Gly, Leu, or Ile
  SITE (545)..(545): Xaa at position 545 is Ile, Ala, Val, Leu, or Gly
  SITE (547)..(547): Xaa at position 547 is Leu, Ala, Val, Gly, or Ile
  SITE (550)..(550): Xaa at position 550 is Ile, Ala, Val, Leu, or Gly
  SITE (551)..(551): Xaa at position 551 is Leu, Ala, Val, Gly, or Ile
  SITE (553)..(553): Xaa at position 553 is Ala, Gly, or Pro
  SITE (554)..(554): Xaa at position 554 is Leu, Ala, Val, Gly, or Ile
MGSAVMDTKKKKDVSSPGGSGGKKNASQKRRSLRVHIPDLSSFAMPLLDGDLEGSGKHSSRKVDSPFGPGSPSKGFFSRGPQPRPSSPMSAPVRPKTSPGSPKTVFPFSYQESPPRSPRRMSFSGIFRSSSKESSPNSNPATSPGGIRFFSRSRKTSGLSSSPSTPTQVTKQHTFPLESYKHEPERLENRIYASSSPPDTGQRFCPSSFQSPTRPPLASPTHYAPSKAAALAAALGPAEAGMLEKLEFEDEAVEDSESGVYMRFXRSHKXYDXVPTSSKLVVFDTTLQXKKXFFAXVANGVRAXPXWESKKQSFVGMXTXTDXXNXXHRYYKSPMVQIYEXEEHKXETWRELYLQETFKPLVNISPDXSXFDXXYSXIKNKIHRXPXIDPISGNALYIXTXKRXXKFXQLFMSDMPKPAXMKQNXDELGXGTYHNIAFIHPDTPXIKXXNIFVERRXSAXPXVDESGKVVDIXSKFDXINLXAEKTYNNXDITXTQAXQHRSQYFEGVVKXNKLEIXETXVDRIVRAEXHRXXXXNEADSIVGIXSXSDXXQXXILTPAGAKQKETETE

SEQ ID NO: 889 - protein, 2413 aa, Homo sapiens
  SITE (1896)..(1896): Xaa at position 1896 is Ala, Gly, or Pro
  SITE (1899)..(1899): Xaa at position 1899 is Val, Ala, Gly, Leu, or Ile
  SITE (1901)..(1901): Xaa at position 1901 is Ile, Ala, Val, Leu, or Gly
  SITE (1910)..(1910): Xaa at position 1910 is Val, Ala, Gly, Leu, or Ile
  SITE (1911)..(1911): Xaa at position 1911 is Cys, Ala, Val, Gly, Ser, or Thr
  SITE (1920)..(1920): Xaa at position 1920 is Ala, Gly, or Pro
  SITE (1922)..(1922): Xaa at position 1922 is Val, Ala, Gly, Leu, or Ile
  SITE (1923)..(1923): Xaa at position 1923 is Val, Ala, Gly, Leu, or Ile
  SITE (1924)..(1924): Xaa at position 1924 is Cys, Ala, Val, Gly, Ser, or Thr
  SITE (1981)..(1981): Xaa at position 1981 is Ala, Gly, or Pro
  SITE (1983)..(1983): Xaa at position 1983 is Val, Ala, Gly, Leu, or Ile
MGISTVILEMCLLWGQVLSTGGWIPRTTDYASLIPSEVPLDPTVAEGSPFPSESTLESTVAEGSPISLESTLESTVAEGSLIPSESTLESTVAEGSDSGLALRLVNGDGRCQGRVEILYRGSWGTVCDDSWDTNDANVVCRQLGCGWAMSAPGNAWFGQGSGPIALDDVRCSGHESYLWSCPHNGWLSHNCGHGEDAGVICSAAQPQSTLRPESWPVRISPPVPTEGSESSLALRLVNGGDRCRGRVEVLYRGSWGTVCDDYWDTNDANVVCRQLGCGWAMSAPGNAQFGQGSGPIVLDDVRCSGHESYLWSCPHNGWLTHNCGHSEDAGVICSAPQSRPTPSPDTWPTSHASTAGPESSLALRLVNGGDRCQGRVEVLYRGSWGTVCDDSWDTSDANVVCRQLGCGWATSAPGNARFGQGSGPIVLDDVRCSGYESYLWSCPHNGWLSHNCQHSEDAGVICSAAHSWSTPSPDTLPTITLPASTVGSESSLALRLVNGGDRCQGRVEVLYRGSWGTVCDDSWDTNDANVVCRQLGCGWAMLAPGNARFGQGSGPIVLDDVRCSGNESYLWSCPHNGWLSHNCGHSEDAGVICSGPESSLALRLVNGGDRCQGRVEVLYRGSWGTVCDDSWDTNDANVVCRQLGCGWATSAPGNARFGQGSGPIVLDDVRCSGHESYLWSCPNNGWLSHNCGHHEDAGVICSAAQSRSTPRPDTLSTITLPPSTVGSESSLTLRLVNGSDRCQGRVEVLYRGSWGTVCDDSWDTNDANVVCRQLGCGWATSAPGNARFGQGSGPIVLDDVRCSGHESYLWSCPHNGWLSHNCGHHEDAGVICSVSQSRPTPSPDTWPTSHASTAGPESSLALRLVNGGDRCQGRVEVLYRGSWGTVCDDSWDTSDANVVCRQLGCGWATSAPGNARFGQGSGPIVLDDVRCSGYESYLWSCPHNGWLSHNCQHSEDAGVICSAAHSWSTPSPDTLPTITLPASTVGSESSLALRLVNGGDRCQGRVEVLYQGSWGTVCDDSWDTNDANVVCRQLGCGWAMSAPGNARFGQGSGPIVLDDVRCSGHESYLWSCPHNGWLSHNCGHSEDAGVICSASQSRPTPSPDTWPTSHASTAGSESSLALRLVNGGDRCQGRVEVLYRGSWGTVCDDYWDTNDANVVCRQLGCGWAMSAPGNARFGQGSGPIVLDDVRCSGHESYLWSCPHNGWLSHNCGHHEDAGVICSASQSQPTPSPDTWPTSHASTAGSESSLALRLVNGGDRCQGRVEVLYRGSWGTVCDDYWDTNDANVVCRQLGCGWATSAPGNARFGQGSGPIVLDDVRCSGHESYLWSCPHNGWLSHNCGHHEDAGVICSASQSQPTPSPDTWPTSHASTAGSESSLALRLVNGGDRCQGRVEVLYRGSWGTVCDDYWDTNDANVVCRQLGCGWATSAPGNARFGQGSGPIVLDDVRCSGHESYLWSCPHNGWLSHNCGHHEDAGVICSASQSQPTPSPDTWPTSRASTAGSESTLALRLVNGGDRCRGRVEVLYQGSWGTVCDDYWDTNDANVVCRQLGCGWAMSAPGNAQFGQGSGPIVLDDVRCSGHESYLWSCPHNGWLSHNCGHHEDAGVICSAAQSQSTPRPDTWLTTNLPALTVGSESSLALRLVNGGDRCRGRVEVLYRGSWGTVCDDSWDTNDANVVCRQLGCGWAMSAPGNARFGQGSGPIVLDDVRCSGNESYLWSCPHKGWLTHNCGHHEDAGVICSATQINSTTTDWWHPTTTTTARPSSNCGGFLFYASGTFSSPSYPAYYPNNAKCVWEIEVNSGYRINLGFSNLKLEAHHNCSFDYVEIFDGSLNSSLLLGKICNDTRQIFTSSYNRMTIHFRSDISFQNTGFLAWYNSFPSDATLRLVNLNSSYGLCXGRXEXYHGGTWGTXXDDSWTIQEXEXXXRQLGCGRAVSALGNAYFGSGSGPITLDDVECSGTESTLWQCRNRGWFSHNCNHREDXGXICSGNHLSTPAPFLNITRPNTDYSCGGFLSQPSGDFSSPFYPGNYPNNAKCVWDIEVQNNYRVTVIFRDVQLEGGCNYDYIEVFDGPYRSSPLIARVCDGARGSFTSSSNFMSIRFISDHSITRRGFRAEYYSSPSNDSTNLLCLPNHMQASVSRSYLQSLGFSASDLVISTWNGYYECRPQITPNLVIFTIPYSGCGTFKQADNDTIDYSNFLTAAVSGGIIKRRTDLRIHVSCRMLQNTWVDTMYIANDTIHVANNTIQVEEVQYGNFDVNISFYTSSSFLYPVTSRPYYVDLNQDLYVQAEILHSDAVLTLFVDTCVASPYSNDFTSLTYDLIRSGCVRDDTYGPYSSPSLRIARFRFRAFHFLNRFPSVYLRCKMVVCRAYDPSSRCYRGCVLRSKRDVGSYQEKVDVVLGPIQLQTPPRREEEPR

SEQ ID NO: 890 - protein, 553 aa, Homo sapiens
  SITE (50)..(50): Xaa at position 50 is Met, Ile, Leu, Val, Ala, or Gly
  SITE (54)..(54): Xaa at position 54 is Leu, Ala, Val, Gly, or Ile
  SITE (82)..(82): Xaa at position 82 is Leu, Ala, Val, Gly, or Ile
  SITE (95)..(95): Xaa at position 95 is Cys, Ala, Val, Gly, Ser, or Thr
  SITE (97)..(97): Xaa at position 97 is Leu, Ala, Val, Gly, or Ile
  SITE (110)..(110): Xaa at position 110 is Ala, Gly, or Pro
  SITE (112)..(112): Xaa at position 112 is Val, Ala, Gly, Leu, or Ile
  SITE (151)..(151): Xaa at position 151 is Ile, Ala, Val, Leu, or Gly
  SITE (153)..(153): Xaa at position 153 is Val, Ala, Gly, Leu, or Ile
  SITE (172)..(172): Xaa at position 172 is Met, Ile, Leu, Val, Ala, or Gly
  SITE (179)..(179): Xaa at position 179 is Leu, Ala, Val, Gly, or Ile
  SITE (181)..(181): Xaa at position 181 is Tyr, Phe, Met, His, Ile, Leu, Val Ala, or Gly
  SITE (183)..(183): Xaa at position 183 is Val, Ala, Gly, Leu, or Ile
  SITE (185)..(185): Xaa at position 185 is Val, Ala, Gly, Leu, or Ile
  SITE (216)..(216): Xaa at position 216 is Val, Ala, Gly, Leu, or Ile
  SITE (218)..(218): Xaa at position 218 is Val, Ala, Gly, Leu, or Ile
MRAPGRPALRPLPLPPLLLLLLAAPWGRAVPCVSGGLPKPANITFLSINXKNVXQWTPPEGLQGVKVTYTVQYFIYGQKKWXNKSECRNINRTYXDXSAETSDYEHQYYXKXKAIWGTKCSKWAESGRFYPFLETQIGPPEVALTTDEKSXSXVLTAPEKWKRNPEDLPVSXQQIYSNXKXNXSXLNTKSNRTWSQCVTNHTLVLTWLEPNTLYCXHXESFVPGPPRRAQPSEKQCARTLKDQSSEFKAKIIFWYVLPVSITVFLFSVMGYSIYRYIHVGKEKHPANLILIYGNEFDKRFFVPAEKIVINFITLNISDDSKISHQDMSLLGKSSDVSSLNDPQPSGNLRPPQEEEEVKHLGYASHLMEIFCDSEENTEGTSLTQQESLSRTIPPDKTVIEYEYDVRTTDICAGPEEQELSLQEEVSTQGTLLESQAALAVLGPQTLQYSYTPQLQDLDPLAQEHTDSEEGPEEEPSTTLVDWDPQTGRLCIPSLSSFDQDSEGCEPSEGDGLGEEGLLSRLYEEPAPDRPPGENETYLMQFMEEWGLYVQMEN

SEQ ID NO: 891 - protein, 476 aa, Homo sapiens
  SITE (141)..(141): Xaa at position 141 is Ile, Ala, Val, Leu, or Gly
  SITE (143)..(143): Xaa at position 143 is Leu, Ala, Val, Gly, or Ile
  SITE (144)..(144): Xaa at position 144 is Ile, Ala, Val, Leu, or Gly
  SITE (158)..(158): Xaa at position 158 is Ile, Ala, Val, Leu, or Gly
  SITE (169)..(169): Xaa at position 169 is Val, Ala, Gly, Leu, or Ile
  SITE (173)..(173): Xaa at position 173 is Val, Ala, Gly, Leu, or Ile
  SITE (187)..(187): Xaa at position 187 is Leu, Ala, Val, Gly, or Ile
  SITE (195)..(195): Xaa at position 195 is Val, Ala, Gly, Leu, or Ile
  SITE (207)..(207): Xaa at position 207 is Tyr, Phe, Met, His, Ile, Leu, Val Ala, or Gly
  SITE (208)..(208): Xaa at position 208 is Val, Ala, Gly, Leu, or Ile
  SITE (209)..(209): Xaa at position 209 is Ala, Gly, or Pro
  SITE (210)..(210): Xaa at position 210 is Val, Ala, Gly, Leu, or Ile
  SITE (220)..(220): Xaa at position 220 is Tyr, Phe, Met, His, Ile, Leu, Val Ala, or Gly
MSGSSARSSHLSQPVVKSVLVYRNGDPFYAGRRVVIHEKKVSSFEVFLKEVTGGVQAPFGAVRNIYTPRTGHRIRKLDQIQSGGNYVAGGQEAFKKLNYLDIGEIKKRPMEVVNTEVKPVIHSRINVSARFRKPLQEPCTXFXXANGDLINPASRLLXPRKTLNQWDHXLQMXTEKITLRSGAVHRXYTLEGKLXESGAELENGQFXXXXGRDKFKKLPXSELLFDKSTMRRPFGQKASSLPPIVGSRKSKGSGNDRHSKSTVGSSDNSSPQPLKRKGKKEDVNSEKLTKLKQNVKLKNSQETIPNSDEGIFKAGAERSETRGAAEVQEDEDTQVEVPVDQRPAEIVDEEEDGEKANKDAEQKEDFSGMNGDLEEEGGREATDAPEQVEEILDHSEQQARPARVNGGTDEENGEELQQVNNELQLVLDKERKSQGAGSGQDEADVDPQRPPRPEVKITSPEENENNQQNKDYAAVA

SEQ ID NO: 892 - protein, 485 aa, Homo sapiens
  SITE (69)..(69): Xaa at position 69 is Leu, Ala, Val, Gly, or Ile
  SITE (73)..(73): Xaa at position 73 is Cys, Ala, Val, Gly, Ser, or Thr
  SITE (78)..(78): Xaa at position 78 is Phe, Tyr, Met, His, Ile, Leu, Val Ala, or Gly
  SITE (79)..(79): Xaa at position 79 is Leu, Ala, Val, Gly, or Ile
  SITE (106)..(106): Xaa at position 106 is Leu, Ala, Val, Gly, or Ile
  SITE (110)..(110): Xaa at position 110 is Leu, Ala, Val, Gly, or Ile
  SITE (114)..(114): Xaa at position 114 is Trp, Tyr, Phe, Met, His, Ile, Leu Val, Ala, or Gly
  SITE (118)..(118): Xaa at position 118 is Val, Ala, Gly, Leu, or Ile
  SITE (125)..(125): Xaa at position 125 is Val, Ala, Gly, Leu, or Ile
  SITE (130)..(130): Xaa at position 130 is Ala, Gly, or Pro
  SITE (185)..(185): Xaa at position 185 is Leu, Ala, Val, Gly, or Ile
  SITE (189)..(189): Xaa at position 189 is Ala, Gly, or Pro
  SITE (190)..(190): Xaa at position 190 is Leu, Ala, Val, Gly, or Ile
  SITE (193)..(193): Xaa at position 193 is Tyr, Phe, Met, His, Ile, Leu, Val Ala, or Gly
  SITE (197)..(197): Xaa at position 197 is Leu, Ala, Val, Gly, or Ile
  SITE (206)..(206): Xaa at position 206 is Tyr, Phe, Met, His, Ile, Leu, Val Ala, or Gly
  SITE (208)..(208): Xaa at position 208 is Leu, Ala, Val, Gly, or Ile
  SITE (209)..(209): Xaa at position 209 is Ala, Gly, or Pro
  SITE (214)..(214): Xaa at position 214 is Cys, Ala, Val, Gly, Ser, or Thr
  SITE (237)..(237): Xaa at position 237 is Ala, Gly, or Pro
  SITE (239)..(239): Xaa at position 239 is Leu, Ala, Val, Gly, or Ile
  SITE (240)..(240): Xaa at position 240 is Val, Ala, Gly, Leu, or Ile
  SITE (241)..(241): Xaa at position 241 is Trp, Tyr, Phe, Met, His, Ile, Leu Val, Ala, or Gly
  SITE (242)..(242): Xaa at position 242 is Phe, Tyr, Met, His, Ile, Leu, Val Ala, or Gly
  SITE (255)..(255): Xaa at position 255 is Trp, Tyr, Phe, Met, His, Ile, Leu Val, Ala, or Gly
  SITE (262)..(262): Xaa at position 262 is Trp, Tyr, Phe, Met, His, Ile, Leu Val, Ala, or Gly
  SITE (263)..(263): Xaa at position 263 is Trp, Tyr, Phe, Met, His, Ile, Leu Val, Ala, or Gly
  SITE (266)..(266): Xaa at position 266 is Phe, Tyr, Met, His, Ile, Leu, Val Ala, or Gly
  SITE (273)..(273): Xaa at position 273 is Phe, Tyr, Met, His, Ile, Leu, Val Ala, or Gly
  SITE (289)..(289): Xaa at position 289 is Leu, Ala, Val, Gly, or Ile
  SITE (293)..(293): Xaa at position 293 is Phe, Tyr, Met, His, Ile, Leu, Val Ala, or Gly
  SITE (295)..(295): Xaa at position 295 is Trp, Tyr, Phe, Met, His, Ile, Leu Val, Ala, or Gly
  SITE (300)..(300): Xaa at position 300 is Ile, Ala, Val, Leu, or Gly
  SITE (303)..(303): Xaa at position 303 is Leu, Ala, Val, Gly, or Ile
  SITE (311)..(311): Xaa at position 311 is Leu, Ala, Val, Gly, or Ile
  SITE (322)..(322): Xaa at position 322 is Leu, Ala, Val, Gly, or Ile
  SITE (335)..(335): Xaa at position 335 is Val, Ala, Gly, Leu, or Ile
  SITE (336)..(336): Xaa at position 336 is Leu, Ala, Val, Gly, or Ile
  SITE (338)..(338): Xaa at position 338 is Val, Ala, Gly, Leu, or Ile
  SITE (342)..(342): Xaa at position 342 is Leu, Ala, Val, Gly, or Ile
  SITE (346)..(346): Xaa at position 346 is Met, Ile, Leu, Val, Ala, or Gly
  SITE (347)..(347): Xaa at position 347 is Leu, Ala, Val, Gly, or Ile
  SITE (348)..(348): Xaa at position 348 is Ala, Gly, or Pro
  SITE (349)..(349): Xaa at position 349 is Tyr, Phe, Met, His, Ile, Leu, Val Ala, or Gly
  SITE (371)..(371): Xaa at position 371 is Val, Ala, Gly, Leu, or Ile
  SITE (372)..(372): Xaa at position 372 is Leu, Ala, Val, Gly, or Ile
  SITE (374)..(374): Xaa at position 374 is Leu, Ala, Val, Gly, or Ile
  SITE (378)..(378): Xaa at position 378 is Leu, Ala, Val, Gly, or Ile
  SITE (379)..(379): Xaa at position 379 is Ala, Gly, or Pro
  SITE (383)..(383): Xaa at position 383 is Val, Ala, Gly, Leu, or Ile
  SITE (384)..(384): Xaa at position 384 is Ala, Gly, or Pro
  SITE (385)..(385): Xaa at position 385 is Leu, Ala, Val, Gly, or Ile
  SITE (387)..(387): Xaa at position 387 is Val, Ala, Gly, Leu, or Ile
  SITE (395)..(395): Xaa at position 395 is Leu, Ala, Val, Gly, or Ile
  SITE (399)..(399): Xaa at position 399 is Cys, Ala, Val, Gly, Ser, or Thr
  SITE (402)..(402): Xaa at position 402 is Leu, Ala, Val, Gly, or Ile
  SITE (406)..(406): Xaa at position 406 is Leu, Ala, Val, Gly, or Ile
  SITE (407)..(407): Xaa at position 407 is Leu, Ala, Val, Gly, or Ile
  SITE (418)..(418): Xaa at position 418 is Leu, Ala, Val, Gly, or Ile
  SITE (437)..(437): Xaa at position 437 is Ile, Ala, Val, Leu, or Gly
  SITE (438)..(438): Xaa at position 438 is Leu, Ala, Val, Gly, or Ile
  SITE (441)..(441): Xaa at position 441 is Val, Ala, Gly, Leu, or Ile
  SITE (443)..(443): Xaa at position 443 is Val, Ala, Gly, Leu, or Ile
  SITE (453)..(453): Xaa at position 453 is Ile, Ala, Val, Leu, or Gly
  SITE (471)..(471): Xaa at position 471 is Leu, Ala, Val, Gly, or Ile
MRSRVAVRACHKVCRCLLSGFGGRVDAGQPELLTERSSPKGGHVKSHAELEGNGEHPEAPGSGEGSEAXLEIXQRRHXXSGSKQQLSRDSLLSGCHPGFGPLGVEXRKNXAAEXWTSXVVFREQXFPVDXLHHKPGPLLPGDSAFRLVSAETLREILQDKELSKEQLVAFLENVLKTSGKLRENXLHGXXEHXVNCXDLVNKRLPXGXXQIGVXFHPVFDTKQIRNGVKSIGEKTEXSXXXXTPPRTSNQWLDFXLRHRLQXXRKXAMSPSNXSSSDCQDEEGRKGNKXYYNXPXGKELXETXWNLGDHEXLHMYPGNVSKXHGRDGRKNVVPCXXSXNGDXDRGXXXXLYDSFQLTENSFTRKKNLHRKXXKXHPCXXPIKXXXDXGRGPTLEXRQVXQGXFNEXXENGISVWPGYXETMQSSLEQLYSKYDEMSXXFTXLXTETTLENGLXHLRSRDTTMKEMMHISKXKDFLIKYISSAKNV

SEQ ID NO: 893 - protein, 191 aa, Homo sapiens
  SITE (86)..(86): Xaa at position 86 is Cys, Ala, Val, Gly, Ser, or Thr
  SITE (87)..(87): Xaa at position 87 is Phe, Tyr, Met, His, Ile, Leu, Val Ala, or Gly
  SITE (103)..(103): Xaa at position 103 is Cys, Ala, Val, Gly, Ser, or Thr
  SITE (108)..(108): Xaa at position 108 is Ala, Gly, or Pro
  SITE (110)..(110): Xaa at position 110 is Leu, Ala, Val, Gly, or Ile
  SITE (111)..(111): Xaa at position 111 is Ala, Gly, or Pro
  SITE (113)..(113): Xaa at position 113 is Val, Ala, Gly, Leu, or Ile
  SITE (122)..(122): Xaa at position 122 is Leu, Ala, Val, Gly, or Ile
  SITE (131)..(131): Xaa at position 131 is His, Phe, Tyr, Lys, Arg, Gly, Ser Thr, Ala, Val, Leu, Ile, Asn, Met, or Gln
  SITE (132)..(132): Xaa at position 132 is Trp, Tyr, Phe, Met, His, Ile, Leu Val, Ala, or Gly
  SITE (133)..(133): Xaa at position 133 is Ile, Ala, Val, Leu, or Gly
  SITE (135)..(135): Xaa at position 135 is Leu, Ala, Val, Gly, or Ile
  SITE (155)..(155): Xaa at position 155 is Phe, Tyr, Met, His, Ile, Leu, Val Ala, or Gly
  SITE (163)..(163): Xaa at position 163 is Cys, Ala, Val, Gly, Ser, or Thr
  SITE (164)..(164): Xaa at position 164 is Ala, Gly, or Pro
  SITE (166)..(166): Xaa at position 166 is Leu, Ala, Val, Gly, or Ile
  SITE (183)..(183): Xaa at position 183 is Ile, Ala, Val, Leu, or Gly
  SITE (184)..(184): Xaa at position 184 is Cys, Ala, Val, Gly, Ser, or Thr
MHDSNNVEKDITPSELPANPGCLHSKEHSIKATLIWRLFFLIMFLTIIVCGMVAALSAIRANCHQEPSVCLQAACPESWIGFQRKXXYFSDDTKNWTSSQRFXDSQDXDXXQXESFQELNFXLRYKGPSDXXXGXSREQGQPWKWINGTEWTRQXPILGAGEXXYXNDKGASSARHYTERKWXXSKSDIHV

SEQ ID NO: 894 - protein, 113 aa, Homo sapiens
  SITE (35)..(35): Xaa at position 35 is Trp, Tyr, Phe, Met, His, Ile, Leu Val, Ala, or Gly
  SITE (60)..(60): Xaa at position 60 is Cys, Ala, Val, Gly, Ser, or Thr
  SITE (71)..(71): Xaa at position 71 is Cys, Ala, Val, Gly, Ser, or Thr
PTEQTPVVRQCYHGNGQSYRGTFSTTVTGRTCQSXSSMTPHRHQRTPENYPNDGLTMNYXRNPDADTGPWXFTMDPSIRWEYCNLTRCSDTEGTVVAPPTVIQVPSLGPPSEQ

SEQ ID NO: 895 - protein, 321 aa, Homo sapiens
  SITE (62)..(62): Xaa at position 62 is Cys, Ala, Val, Gly, Ser, or Thr
MGEWTILERLLEAAVQQHSTMIGRILLTVVVIFRILIVAIVGETVYDDEQTMFVCNTLQPGXNQACYDRAFPISHIRYWVFQIIMVCTPSLCFITYSVHQSAKQRERRYSTVFLALDRDPPESIGGPGGTGGGGSGGGKREDKKLQNAIVNGVLQNTENTSKETEPDCLEVKELTPHPSGLRTASKSKLRRQEGISRFYIIQVVFRNALEIGFLVGQYFLYGFSVPGLYECNRYPCIKEVECYVSRPTEKTVFLVFMFAVSGICVVLNLAELNHLGWRKIKLAVRGAQAKRKSIYEIRNKDLPRVSVPNFGRTQSSDSAYV

SEQ ID NO: 896 - protein, 699 aa, Homo sapiens
  SITE (253)..(253): Xaa at position 253 is Val, Ala, Gly, Leu, or Ile
  SITE (257)..(257): Xaa at position 257 is Phe, Tyr, Met, His, Ile, Leu, Val Ala, or Gly
  SITE (260)..(260): Xaa at position 260 is Ala, Gly, or Pro
  SITE (264)..(264): Xaa at position 264 is Tyr, Phe, Met, His, Ile, Leu, Val Ala, or Gly
  SITE (268)..(268): Xaa at position 268 is Ala, Gly, or Pro
  SITE (274)..(274): Xaa at position 274 is Leu, Ala, Val, Gly, or Ile
  SITE (287)..(287): Xaa at position 287 is Leu, Ala, Val, Gly, or Ile
  SITE (289)..(289): Xaa at position 289 is Leu, Ala, Val, Gly, or Ile
  SITE (291)..(291): Xaa at position 291 is Leu, Ala, Val, Gly, or Ile
  SITE (292)..(292): Xaa at position 292 is Ile, Ala, Val, Leu, or Gly
  SITE (294)..(294): Xaa at position 294 is Ala, Gly, or Pro
  SITE (295)..(295): Xaa at position 295 is Leu, Ala, Val, Gly, or Ile
  SITE (298)..(298): Xaa at position 298 is Met, Ile, Leu, Val, Ala, or Gly
  SITE (310)..(310): Xaa at position 310 is Ala, Gly, or Pro
  SITE (314)..(314): Xaa at position 314 is Val, Ala, Gly, Leu, or Ile
  SITE (318)..(318): Xaa at position 318 is Leu, Ala, Val, Gly, or Ile
  SITE (320)..(320): Xaa at position 320 is Phe, Tyr, Met, His, Ile, Leu, Val Ala, or Gly
  SITE (326)..(326): Xaa at position 326 is Val, Ala, Gly, Leu, or Ile
  SITE (328)..(328): Xaa at position 328 is Leu, Ala, Val, Gly, or Ile
  SITE (335)..(335): Xaa at position 335 is Ile, Ala, Val, Leu, or Gly
  SITE (336)..(336): Xaa at position 336 is Leu, Ala, Val, Gly, or Ile
  SITE (339)..(339): Xaa at position 339 is Leu, Ala, Val, Gly, or Ile
  SITE (340)..(340): Xaa at position 340 is Leu, Ala, Val, Gly, or Ile
  SITE (342)..(342): Xaa at position 342 is Ala, Gly, or Pro
  SITE (351)..(351): Xaa at position 351 is Phe, Tyr, Met, His, Ile, Leu, Val Ala, or Gly
  SITE (355)..(355): Xaa at position 355 is Ala, Gly, or Pro
  SITE (358)..(358): Xaa at position 358 is Phe, Tyr, Met, His, Ile, Leu, Val Ala, or Gly
  SITE (362)..(362): Xaa at position 362 is Leu, Ala, Val, Gly, or Ile
  SITE (365)..(365): Xaa at position 365 is Ala, Gly, or Pro
  SITE (372)..(372): Xaa at position 372 is Ile, Ala, Val, Leu, or Gly
  SITE (377)..(377): Xaa at position 377 is Val, Ala, Gly, Leu, or Ile
  SITE (379)..(379): Xaa at position 379 is Ile, Ala, Val, Leu, or Gly
  SITE (395)..(395): Xaa at position 395 is Val, Ala, Gly, Leu, or Ile
  SITE (401)..(401): Xaa at position 401 is Ile, Ala, Val, Leu, or Gly
  SITE (403)..(403): Xaa at position 403 is Leu, Ala, Val, Gly, or Ile
  SITE (405)..(405): Xaa at position 405 is Phe, Tyr, Met, His, Ile, Leu, Val Ala, or Gly
  SITE (408)..(408): Xaa at position 408 is Leu, Ala, Val, Gly, or Ile
  SITE (417)..(417): Xaa at position 417 is Phe, Tyr, Met, His, Ile, Leu, Val Ala, or Gly
  SITE (421)..(421): Xaa at position 421 is Val, Ala, Gly, Leu, or Ile
  SITE (424)..(424): Xaa at position 424 is Val, Ala, Gly, Leu, or Ile
  SITE (428)..(428): Xaa at position 428 is Ile, Ala, Val, Leu, or Gly
  SITE (438)..(438): Xaa at position 438 is Leu, Ala, Val, Gly, or Ile
  SITE (439)..(439): Xaa at position 439 is Val, Ala, Gly, Leu, or Ile
  SITE (443)..(443): Xaa at position 443 is Ile, Ala, Val, Leu, or Gly
  SITE (458)..(458): Xaa at position 458 is Leu, Ala, Val, Gly, or Ile
  SITE (462)..(462): Xaa at position 462 is Ala, Gly, or Pro
  SITE (466)..(466): Xaa at position 466 is Tyr, Phe, Met, His, Ile, Leu, Val Ala, or Gly
  SITE (468)..(468): Xaa at position 468 is Tyr, Phe, Met, His, Ile, Leu, Val Ala, or Gly
  SITE (470)..(470): Xaa at position 470 is Leu, Ala, Val, Gly, or Ile
  SITE (474)..(474): Xaa at position 474 is Ile, Ala, Val, Leu, or Gly
  SITE (487)..(487): Xaa at position 487 is Tyr, Phe, Met, His, Ile, Leu, Val Ala, or Gly
  SITE (490)..(490): Xaa at position 490 is Ala, Gly, or Pro
  SITE (491)..(491): Xaa at position 491 is Ile, Ala, Val, Leu, or Gly
  SITE (494)..(494): Xaa at position 494 is Val, Ala, Gly, Leu, or Ile
  SITE (498)..(498): Xaa at position 498 is Leu, Ala, Val, Gly, or Ile
  SITE (509)..(509): Xaa at position 509 is Phe, Tyr, Met, His, Ile, Leu, Val Ala, or Gly
  SITE (510)..(510): Xaa at position 510 is Val, Ala, Gly, Leu, or Ile
  SITE (513)..(513): Xaa at position 513 is Leu, Ala, Val, Gly, or Ile
  SITE (522)..(522): Xaa at position 522 is Met, Ile, Leu, Val, Ala, or Gly
  SITE (527)..(527): Xaa at position 527 is Cys, Ala, Val, Gly, Ser, or Thr
  SITE (529)..(529): Xaa at position 529 is Leu, Ala, Val, Gly, or Ile
  SITE (533)..(533): Xaa at position 533 is Leu, Ala, Val, Gly, or Ile
  SITE (534)..(534): Xaa at position 534 is Ala, Gly, or Pro
  SITE (545)..(545): Xaa at position 545 is His, Phe, Tyr, Lys, Arg, Gly, Ser Thr, Ala, Val, Leu, Ile, Asn, Met, or Gln
  SITE (548)..(548): Xaa at position 548 is Leu, Ala, Val, Gly, or Ile
  SITE (549)..(549): Xaa at position 549 is Ala, Gly, or Pro
  SITE (552)..(552): Xaa at position 552 is Leu, Ala, Val, Gly, or Ile
  SITE (553)..(553): Xaa at position 553 is Met, Ile, Leu, Val, Ala, or Gly
  SITE (556)..(556): Xaa at position 556 is Cys, Ala, Val, Gly, Ser, or Thr
  SITE (559)..(559): Xaa at position 559 is Met, Ile, Leu, Val, Ala, or Gly
  SITE (567)..(567): Xaa at position 567 is Leu, Ala, Val, Gly, or Ile
  SITE (572)..(572): Xaa at position 572 is Val, Ala, Gly, Leu, or Ile
  SITE (585)..(585): Xaa at position 585 is Val, Ala, Gly, Leu, or Ile
  SITE (596)..(596): Xaa at position 596 is Leu, Ala, Val, Gly, or Ile
  SITE (601)..(601): Xaa at position 601 is Val, Ala, Gly, Leu, or Ile
  SITE (604)..(604): Xaa at position 604 is Leu, Ala, Val, Gly, or Ile
  SITE (605)..(605): Xaa at position 605 is Phe, Tyr, Met, His, Ile, Leu, Val Ala, or Gly
  SITE (607)..(607): Xaa at position 607 is Leu, Ala, Val, Gly, or Ile
  SITE (616)..(616): Xaa at position 616 is Tyr, Phe, Met, His, Ile, Leu, Val Ala, or Gly
  SITE (623)..(623): Xaa at position 623 is Ile, Ala, Val, Leu, or Gly
  SITE (624)..(624): Xaa at position 624 is Leu, Ala, Val, Gly, or Ile
  SITE (641)..(641): Xaa at position 641 is Ile, Ala, Val, Leu, or Gly
  SITE (644)..(644): Xaa at position 644 is Val, Ala, Gly, Leu, or Ile
  SITE (656)..(656): Xaa at position 656 is Met, Ile, Leu, Val, Ala, or Gly
  SITE (660)..(660): Xaa at position 660 is Phe, Tyr, Met, His, Ile, Leu, Val Ala, or Gly
  SITE (661)..(661): Xaa at position 661 is Leu, Ala, Val, Gly, or Ile
  SITE (665)..(665): Xaa at position 665 is Leu, Ala, Val, Gly, or Ile
  SITE (667)..(667): Xaa at position 667 is Tyr, Phe, Met, His, Ile, Leu, Val Ala, or Gly
  SITE (668)..(668): Xaa at position 668 is Leu, Ala, Val, Gly, or Ile
  SITE (670)..(670): Xaa at position 670 is Leu, Ala, Val, Gly, or Ile
  SITE (671)..(671): Xaa at position 671 is Leu, Ala, Val, Gly, or Ile
  SITE (685)..(685): Xaa at position 685 is Val, Ala, Gly, Leu, or Ile
  SITE (686)..(686): Xaa at position 686 is Phe, Tyr, Met, His, Ile, Leu, Val Ala, or Gly
  SITE (690)..(690): Xaa at position 690 is Ala, Gly, or Pro
  SITE (691)..(691): Xaa at position 691 is His, Phe, Tyr, Lys, Arg, Gly, Ser Thr, Ala, Val, Leu, Ile, Asn, Met, or Gln
  SITE (693)..(693): Xaa at position 693 is Leu, Ala, Val, Gly, or Ile
MAACEGRRSGALGSSQSDFLTPPVGGAPWAVATTVVMYPPPPPPPHRDFISVTLSFGENYDNSKSWRRRSCWRKWKQLSRLQRNMILFLLAFLLFCGLLFYINLADHWKALAFRLEEEQKMRPEIAGLKPANPPVLPAPQKADTDPENLPEISSQKTQRHIQRGPPHLQIRPPSQDLKDGTQEEATKRQEAPVDPRPEGDPQRTVISWRGAVIEPEQGTELPSRRAEVPTKPPLPPARTQGTPVHLNYRQKGXIDVXLHXWKGXRKFXWGHDEXKPVSRSFSEWFGXGXTXXDXXDTXWILGLRKEFEEXRKWXSKKXHXEKDVDXNXFESTIRXXGGXXSXYHLSGDSLXLRKXEDXGNRXMPXFRTPSKXPYSDXNXGTGVAHPPRWTSDSTXAEVTSXQXEXREXSRLTGDKKXQEAXEKXTQHXHGLSGKKDGXXPMFXNTHSGLFTHLGVFTXGARXDSYXEXLXKQWXQGGKQETQLLEDXVEXXEGXRTHXLRHSEPSKLTXXGEXAHGRFSAKXDHLVXFXPGTXXLGVYHGLPASXMEXXQEXXETXYQXNRQMETGXSPEIXHFNLYPQPGRRDXEVKPADRHNLXRPETXESXXYXYRVTGDRKXQDWGWEXXQSFSRFTRVPSGGYSSXNNXQDPQKPEPRDKXESFXXGETXKXXFXXFSDDPNLLSLDAYXXNTEXXPXPIWTPA

SEQ ID NO: 897 - protein, 775 aa, Homo sapiens
  SITE (423)..(423): Xaa at position 423 is Cys, Ala, Val, Gly, Ser, or Thr
  SITE (434)..(434): Xaa at position 434 is Cys, Ala, Val, Gly, Ser, or Thr
  SITE (452)..(452): Xaa at position 452 is Cys, Ala, Val, Gly, Ser, or Thr
  SITE (453)..(453): Xaa at position 453 is Cys, Ala, Val, Gly, Ser, or Thr
  SITE (485)..(485): Xaa at position 485 is Cys, Ala, Val, Gly, Ser, or Thr
MLQGLLPVSLLLSVAVSAIKELPGVKKYEVVYPIRLHPLHKREAKEPEQQEQFETELKYKMTINGKIAVLYLKKNKNLLAPGYTETYYNSTGKEITTSPQIMDDCYYQGHILNEKVSDASISTCRGLRGYFSQGDQRYFIEPLSPIHRDGQEHALFKYNPDEKNYDSTCGMDGVLWAHDLQQNIALPATKLVKLKDRKVQEHEKYIEYYLVLDNGEFKRYNENQDEIRKRVFEMANYVNMLYKKLNTHVALVGMEIWTDKDKIKITPNASFTLENFSKWRGSVLSRRKRHDIAQLITATELAGTTVGLAFMSTMCSPYSVGVVQDHSDNLLRVAGTMAHEMGHNFGMFHDDYSCKCPSTICVMDKALSFYIPTDFSSCSRLSYDKFFEDKLSNCLFNAPLPTDIISTPICGNQLVEMGEDCDXGTSEECTNICXDAKTCKIKATFQCALGEXXEKCQFKKAGMVCRPAKDECDLPEMCNGKSGNXPDDRFQVNGFPCHHGKGHCLMGTCPTLQEQCTELWGPGTEVADKSCYNRNEGGSKYGYCRRVDDTLIPCKANDTMCGKLFCQGGSDNLPWKGRIVTFLTCKTFDPEDTSQEIGMVANGTKCGDNKVCINAECVDIEKAYKSTNCSSKCKGHAVCDHELQCQCEEGWIPPDCDDSSVVFHFSIVVGVLFPMAVIFVVVAMVIRHQSSREKQKKDQRPLSTTGTRPHKQKRKPQMVKAVQPQEMSQMKPHVYDLPVEGNEPPASFHKDTNALPPTVFKDNPVSTPKDSNPKA

SEQ ID NO: 898 - protein, 537 aa, Homo sapiens
  SITE (50)..(50): Xaa at position 50 is Ile, Ala, Val, Leu, or Gly
  SITE (53)..(53): Xaa at position 53 is Cys, Ala, Val, Gly, Ser, or Thr
  SITE (75)..(75): Xaa at position 75 is Ala, Gly, or Pro
  SITE (79)..(79): Xaa at position 79 is Leu, Ala, Val, Gly, or Ile
  SITE (94)..(94): Xaa at position 94 is Leu, Ala, Val, Gly, or Ile
  SITE (97)..(97): Xaa at position 97 is Phe, Tyr, Met, His, Ile, Leu, Val Ala, or Gly
  SITE (98)..(98): Xaa at position 98 is Leu, Ala, Val, Gly, or Ile
  SITE (99)..(99): Xaa at position 99 is Cys, Ala, Val, Gly, Ser, or Thr
  SITE (101)..(101): Xaa at position 101 is Val, Ala, Gly, Leu, or Ile
  SITE (102)..(102): Xaa at position 102 is Tyr, Phe, Met, His, Ile, Leu, Val Ala, or Gly
  SITE (103)..(103): Xaa at position 103 is Val, Ala, Gly, Leu, or Ile
  SITE (117)..(117): Xaa at position 117 is Cys, Ala, Val, Gly, Ser, or Thr
  SITE (121)..(121): Xaa at position 121 is Cys, Ala, Val, Gly, Ser, or Thr
  SITE (124)..(124): Xaa at position 124 is Val, Ala, Gly, Leu, or Ile
  SITE (128)..(128): Xaa at position 128 is Cys, Ala, Val, Gly, Ser, or Thr
  SITE (132)..(132): Xaa at position 132 is Leu, Ala, Val, Gly, or Ile
  SITE (135)..(135): Xaa at position 135 is Phe, Tyr, Met, His, Ile, Leu, Val Ala, or Gly
  SITE (143)..(143): Xaa at position 143 is Leu, Ala, Val, Gly, or Ile
MAWRGAGPSVPGAPGGVGLSLGLLLQLLLLLGPARGFGDEEERRCDPIRXSMXQNLGYNVTKMPNLVGHELQTDXELQXTTFTPLIQYGCSSQXQFXXXSXXXPMCTEKINIPIGPXGGMXLSXKRRXEPVXKEXGFAWPESXNCSKFPPQNDHNHMCMEGPGDEEVPLPHKTPIQPGEECHSVGTNSDQYIWVKRSLNCVLKCGYDAGLYSRSAKEFTDIWMAVWASLCFISTAFTVLTFLIDSSRFSYPERPIIFLSMCYNIYSIAYIVRLTVGRERISCDFEEAAEPVLIQEGLKNTGCAIIFLLMYFFGMASSIWWVILTLTWFLAAGLKWGHEAIEMHSSYFHIAAWAIPAVKTIVILIMRLVDADELTGLCYVGNQNLDALTGFVVAPLFTYLVIGTLFIAAGLVALFKIRSNLQKDGTKTDKLERLMVKIGVFSVLYTVPATCVIACYFYEISNWALFRYSADDSNMAVEMLKIFMSLLVGITSGMWIWSAKTLHTWQKCSNRLVNSGKVKREKRGNGWVKPGKGSETVV

SEQ ID NO: 899 - protein, 492 aa, Homo sapiens
  SITE (21)..(21): Xaa at position 21 is Leu, Ala, Val, Gly, or Ile
  SITE (24)..(24): Xaa at position 24 is Leu, Ala, Val, Gly, or Ile
  SITE (27)..(27): Xaa at position 27 is Leu, Ala, Val, Gly, or Ile
  SITE (28)..(28): Xaa at position 28 is Val, Ala, Gly, Leu, or Ile
  SITE (37)..(37): Xaa at position 37 is Ile, Ala, Val, Leu, or Gly
  SITE (46)..(46): Xaa at position 46 is Phe, Tyr, Met, His, Ile, Leu, Val Ala, or Gly
  SITE (48)..(48): Xaa at position 48 is Val, Ala, Gly, Leu, or Ile
  SITE (54)..(54): Xaa at position 54 is Phe, Tyr, Met, His, Ile, Leu, Val Ala, or Gly
  SITE (58)..(58): Xaa at position 58 is Val, Ala, Gly, Leu, or Ile
  SITE (59)..(59): Xaa at position 59 is Leu, Ala, Val, Gly, or Ile
  SITE (71)..(71): Xaa at position 71 is Phe, Tyr, Met, His, Ile, Leu, Val Ala, or Gly
  SITE (75)..(75): Xaa at position 75 is Leu, Ala, Val, Gly, or Ile
  SITE (101)..(101): Xaa at position 101 is Phe, Tyr, Met, His, Ile, Leu, Val Ala, or Gly
  SITE (106)..(106): Xaa at position 106 is Phe, Tyr, Met, His, Ile, Leu, Val Ala, or Gly
  SITE (114)..(114): Xaa at position 114 is Leu, Ala, Val, Gly, or Ile
  SITE (117)..(117): Xaa at position 117 is Val, Ala, Gly, Leu, or Ile
MQEAPAALPTEPGPSPVPAFXGKXWAXXGDPGTDHLXRWSPSGTSXLXSDQSRXAKEXXPQYFKHSNMASXVRQXNMYGFRKVVSIEQGGLLRPERDHVEXQHPSXVRGREQLXERXRRKVPALRGDDGRWRPEDLGRLLGEVQALRGVQESTEARLRELRQQNEILWREVVTLRQSHGQQHRVIGKLIQCLFGPLQAGPSNAGGKRKLSLMLDEGSSCPTPAKFNTCPLPGALLQDPYFIQSPLPETNLGLSPHRARGPIISDIPEDSPSPEGTRLSPSSDGRREKGLALLKEEPASPGGDGEAGLALAPNECDFCVTAPPPLPVAVVQAILEGKGSFSPEGPRNAQQPEPGDPREIPDRGPLGLESGDRSPESLLPPMLLQPPQESVEPAGPLDVLGPSLQGREWTLMDLDMELSLMQPLVPERGEPELAVKGLNSPSPGKDPTLGAPLLLDVQAALGGPALGLPGALTIYSTPESRTASYLGPEASPSP

SEQ ID NO: 900 - protein, 2321 aa, Homo sapiens
  SITE (194)..(194): Xaa at position 194 is Cys, Ala, Val, Gly, Ser, or Thr
  SITE (428)..(428): Xaa at position 428 is Cys, Ala, Val, Gly, Ser, or Thr
  SITE (466)..(466): Xaa at position 466 is Cys, Ala, Val, Gly, Ser, or Thr
  SITE (504)..(504): Xaa at position 504 is Cys, Ala, Val, Gly, Ser, or Thr
  SITE (617)..(617): Xaa at position 617 is Cys, Ala, Val, Gly, Ser, or Thr
  SITE (884)..(884): Xaa at position 884 is Cys, Ala, Val, Gly, Ser, or Thr
  SITE (921)..(921): Xaa at position 921 is Cys, Ala, Val, Gly, Ser, or Thr
  SITE (1405)..(1405): Xaa at position 1405 is Cys, Ala, Val, Gly, Ser, or Thr
  SITE (1417)..(1417): Xaa at position 1417 is Cys, Ala, Val, Gly, Ser, or Thr
  SITE (1437)..(1437): Xaa at position 1437 is Phe, Tyr, Met, His, Ile, Leu Val, Ala, or Gly
  SITE (1446)..(1446): Xaa at position 1446 is Cys, Ala, Val, Gly, Ser, or Thr
  SITE (1451)..(1451): Xaa at position 1451 is Cys, Ala, Val, Gly, Ser, or Thr
  SITE (1456)..(1456): Xaa at position 1456 is Phe, Tyr, Met, His, Ile, Leu Val, Ala, or Gly
  SITE (1475)..(1475): Xaa at position 1475 is Cys, Ala, Val, Gly, Ser, or Thr
  SITE (1476)..(1476): Xaa at position 1476 is Ala, Gly, or Pro
  SITE (1513)..(1513): Xaa at position 1513 is Leu, Ala, Val, Gly, or Ile
  SITE (1514)..(1514): Xaa at position 1514 is Val, Ala, Gly, Leu, or Ile
  SITE (1515)..(1515): Xaa at position 1515 is Leu, Ala, Val, Gly, or Ile
  SITE (1517)..(1517): Xaa at position 1517 is Val, Ala, Gly, Leu, or Ile
  SITE (1524)..(1524): Xaa at position 1524 is Leu, Ala, Val, Gly, or Ile
  SITE (1531)..(1531): Xaa at position 1531 is Phe, Tyr, Met, His, Ile, Leu Val, Ala, or Gly
  SITE (1535)..(1535): Xaa at position 1535 is Leu, Ala, Val, Gly, or Ile
  SITE (1539)..(1539): Xaa at position 1539 is Leu, Ala, Val, Gly, or Ile
  SITE (1582)..(1582): Xaa at position 1582 is Val, Ala, Gly, Leu, or Ile
  SITE (1584)..(1584): Xaa at position 1584 is Leu, Ala, Val, Gly, or Ile
  SITE (1586)..(1586): Xaa at position 1586 is Ile, Ala, Val, Leu, or Gly
  SITE (1604)..(1604): Xaa at position 1604 is Ala, Gly, or Pro
  SITE (1607)..(1607): Xaa at position 1607 is Ala, Gly, or Pro
  SITE (1608)..(1608): Xaa at position 1608 is Ala, Gly, or Pro
  SITE (1611)..(1611): Xaa at position 1611 is Leu, Ala, Val, Gly, or Ile
  SITE (1613)..(1613): Xaa at position 1613 is Ala, Gly, or Pro
MGPGARGRRRRRRPMSPPPPPPPVRALPLLLLLAGPGAAAPPCLDGSPCANGGRCTQLPSREAACLCPPGWVGERCQLEDPCHSGPCAGRGVCQSSVVAGTARFSCRCPRGFRGPDCSLPDPCLSSPCAHGARCSVGPDGRFLCSCPPGYQGRSCRSDVDECRVGEPCRHGGTCLNTPGSFRCQCPAGYTGPLXENPAVPCAPSPCRNGGTCRQSGDLTYDCACLPGFEGQNCEVNVDDCPGHRCLNGGTCVDGVNTYNCQCPPEWTGQFCTEDVDECQLQPNACHNGGTCFNTLGGHSCVCVNGWTGESCSQNIDDCATAVCFHGATCHDRVASFYCACPMGKTGLLCHLDDACVSNPCHEDAICDTNPVNGRAICTCPPGFTGGACDQDVDECSIGANPCEHLGRCVNTQGSFLCQCGRGYTGPRXETDVNECLSGPCRNQATCLDRIGQFTCICMAGFTGTYXEVDIDECQSSPCVNGGVCKDRVNGFSCTCPSGFSGSTXQLDVDECASTPCRNGAKCVDQPDGYECRCAEGFEGTLCDRNVDDCSPDPCHHGRCVDGIASFSCACAPGYTGTRCESQVDECRSQPCRHGGKCLDLVDKYLCRCPSGTTGVNXEVNIDDCASNPCTFGVCRDGINRYDCVCQPGFTGPLCNVEINECASSPCGEGGSCVDGENGFRCLCPPGSLPPLCLPPSHPCAHEPCSHGICYDAPGGFRCVCEPGWSGPRCSQSLARDACESQPCRAGGTCSSDGMGFHCTCPPGVQGRQCELLSPCTPNPCEHGGRCESAPGQLPVCSCPQGWQGPRCQQDVDECAGPAPCGPHGICTNLAGSFSCTCHGGYTGPSCDQDINDCDPNPCLNGGSCQDGVGSFSCSCLPGFAGPRXARDVDECLSNPCGPGTCTDHVASFTCTCPPGYGGFHXEQDLPDCSPSSCFNGGTCVDGVNSFSCLCRPGYTGAHCQHEADPCLSRPCLHGGVCSAAHPGFRCTCLESFTGPQCQTLVDWCSRQPCQNGGRCVQTGAYCLCPPGWSGRLCDIRSLPCREAAAQIGVRLEQLCQAGGQCVDEDSSHYCVCPEGRTGSHCEQEVDPCLAQPCQHGGTCRGYMGGYMCECLPGYNGDNCEDDVDECASQPCQHGGSCIDLVARYLCSCPPGTLGVLCEINEDDCGPGPPLDSGPRCLHNGTCVDLVGGFRCTCPPGYTGLRCEADINECRSGACHAAHTRDCLQDPGGGFRCLCHAGFSGPRCQTVLSPCESQPCQHGGQCRPSPGPGGGLTFTCHCAQPFWGPRCERVARSCRELQCPVGVPCQQTPRGPRCACPPGLSGPSCRSFPGSPPGASNASCAAAPCLHGGSCRPAPLAPFFRCACAQGWTGPRCEAPAAAPEVSEEPRCPRAACQAKRGDQRCDREXNSPGCGWDGGDXSLSVGDPWRQCEALQCWRLXNNSRCDPAXSSPAXLYDNXDCHAGGRERTCNPVYEKYXXDHFADGRCDQGCNTEECGWDGLDCASEVPALLARGVXXXTXLLPPEEXLRSSADXLQRXSAIXRTSLRFRLDAHGQAMVFPYHRPSPGSEPRARRELAPEVIGSVXMXEXDNRLCLQSPENDHCFPDXQSXXDYXGXLSAVERLDFPYPLRDVRGEPLEPPEPSVPLLPLLVAGAVLLLVILVLGVMVARRKREHSTLWFPEGFSLHKDVASGHKGRREPVGQDALGMKNMAKGESLMGEVATDWMDTECPEAKRLKVEEPGMGAEEAVDCRQWTQHHLVAADIRVAPAMALTPPQGDADADGMDVNVRGPDGFTPLMLASFCGGALEPMPTEEDEADDTSASIISDLICQGAQLGARTDRTGETALHLAARYARADAAKRLLDAGADTNAQDHSGRTPLHTAVTADAQGVFQILIRNRSTDLDARMADGSTALILAARLAVEGMVEELIASHADVNAVDELGKSALHWAAAVNNVEATLALLKNGANKDMQDSKEETPLFLAAREGSYEAAKLLLDHFANREITDHLDRLPRDVAQERLHQDIVRLLDQPSGPRSPPGPHGLGPLLCPPGAFLPGLKAAQSGSKKSRRPPGKAGLGPQGPRGRGKKLTLACPGPLADSSVTLSPVDSLDSPRPFGGPPASPGGFPLEGPYAAATATAVSLAQLGGPGRAGLGRQPPGGCVLSLGLLNPVAVPLDWARLPPPAPPGPSFLLPLAPGPQLLNPGTPVSPQERPPPYLAVPGHGEEYPAAGAHSSPPKARFLRVPSEHPYLTPSPESPEHWASPSPPSLSDWSESTPSPATATGAMATTTGALPAQPLPLSVPSSLAQAQTQLGPQPEVTPKRQVLA

SEQ ID NO: 901 - protein, 1294 aa, Homo sapiens
  SITE (9)..(9): Xaa at position 9 is Ala, Gly, or Pro
  SITE (31)..(31): Xaa at position 31 is Ile, Ala, Val, Leu, or Gly
  SITE (43)..(43): Xaa at position 43 is Ala, Gly, or Pro
  SITE (63)..(63): Xaa at position 63 is Cys, Ala, Val, Gly, Ser, or Thr
  SITE (65)..(65): Xaa at position 65 is Leu, Ala, Val, Gly, or Ile
  SITE (71)..(71): Xaa at position 71 is Ala, Gly, or Pro
  SITE (73)..(73): Xaa at position 73 is Leu, Ala, Val, Gly, or Ile
  SITE (74)..(74): Xaa at position 74 is Leu, Ala, Val, Gly, or Ile
  SITE (77)..(77): Xaa at position 77 is Ile, Ala, Val, Leu, or Gly
  SITE (86)..(86): Xaa at position 86 is Ile, Ala, Val, Leu, or Gly
  SITE (90)..(90): Xaa at position 90 is Val, Ala, Gly, Leu, or Ile
  SITE (93)..(93): Xaa at position 93 is Ile, Ala, Val, Leu, or Gly
  SITE (94)..(94): Xaa at position 94 is Leu, Ala, Val, Gly, or Ile
  SITE (95)..(95): Xaa at position 95 is Ile, Ala, Val, Leu, or Gly
  SITE (96)..(96): Xaa at position 96 is Ala, Gly, or Pro
  SITE (103)..(103): Xaa at position 103 is Ile, Ala, Val, Leu, or Gly
  SITE (112)..(112): Xaa at position 112 is Ile, Ala, Val, Leu, or Gly
  SITE (127)..(127): Xaa at position 127 is Val, Ala, Gly, Leu, or Ile
  SITE (128)..(128): Xaa at position 128 is Phe, Tyr, Met, His, Ile, Leu, Val Ala, or Gly
  SITE (129)..(129): Xaa at position 129 is Ala, Gly, or Pro
  SITE (130)..(130): Xaa at position 130 is Ile, Ala, Val, Leu, or Gly
  SITE (131)..(131): Xaa at position 131 is Ala, Gly, or Pro
  SITE (134)..(134): Xaa at position 134 is Ala, Gly, or Pro
  SITE (138)..(138): Xaa at position 138 is Met, Ile, Leu, Val, Ala, or Gly
  SITE (140)..(140): Xaa at position 140 is Val, Ala, Gly, Leu, or Ile
  SITE (147)..(147): Xaa at position 147 is Ile, Ala, Val, Leu, or Gly
  SITE (148)..(148): Xaa at position 148 is Ile, Ala, Val, Leu, or Gly
  SITE (149)..(149): Xaa at position 149 is Val, Ala, Gly, Leu, or Ile
  SITE (155)..(155): Xaa at position 155 is Ala, Gly, or Pro
  SITE (164)..(164): Xaa at position 164 is Val, Ala, Gly, Leu, or Ile
  SITE (167)..(167): Xaa at position 167 is Tyr, Phe, Met, His, Ile, Leu, Val Ala, or Gly
  SITE (168)..(168): Xaa at position 168 is Leu, Ala, Val, Gly, or Ile
  SITE (185)..(185): Xaa at position 185 is Ala, Gly, or Pro
  SITE (188)..(188): Xaa at position 188 is Leu, Ala, Val, Gly, or Ile
  SITE (189)..(189): Xaa at position 189 is Leu, Ala, Val, Gly, or Ile
  SITE (191)..(191): Xaa at position 191 is Ala, Gly, or Pro
  SITE (192)..(192): Xaa at position 192 is Phe, Tyr, Met, His, Ile, Leu, Val Ala, or Gly
  SITE (195)..(195): Xaa at position 195 is Ala, Gly, or Pro
  SITE (206)..(206): Xaa at position 206 is Phe, Tyr, Met, His, Ile, Leu, Val Ala, or Gly
  SITE (209)..(209): Xaa at position 209 is Phe, Tyr, Met, His, Ile, Leu, Val Ala, or Gly
  SITE (212)..(212): Xaa at position 212 is Ile, Ala, Val, Leu, or Gly
  SITE (214)..(214): Xaa at position 214 is Phe, Tyr, Met, His, Ile, Leu, Val Ala, or Gly
  SITE (220)..(220): Xaa at position 220 is Val, Ala, Gly, Leu, or Ile
  SITE (235)..(235): Xaa at position 235 is Ile, Ala, Val, Leu, or Gly
  SITE (245)..(245): Xaa at position 245 is Tyr, Phe, Met, His, Ile, Leu, Val Ala, or Gly
  SITE (246)..(246): Xaa at position 246 is His, Phe, Tyr, Lys, Arg, Gly, Ser Thr, Ala, Val, Leu, Ile, Asn, Met, or Gln
  SITE (247)..(247): Xaa at position 247 is Ile, Ala, Val, Leu, or Gly
  SITE (248)..(248): Xaa at position 248 is Phe, Tyr, Met, His, Ile, Leu, Val Ala, or Gly
  SITE (249)..(249): Xaa at position 249 is Tyr, Phe, Met, His, Ile, Leu, Val Ala, or Gly
  SITE (251)..(251): Xaa at position 251 is Leu, Ala, Val, Gly, or Ile
  SITE (252)..(252): Xaa at position 252 is Cys, Ala, Val, Gly, Ser, or Thr
  SITE (265)..(265): Xaa at position 265 is Leu, Ala, Val, Gly, or Ile
  SITE (271)..(271): Xaa at position 271 is Phe, Tyr, Met, His, Ile, Leu, Val Ala, or Gly
  SITE (273)..(273): Xaa at position 273 is Tyr, Phe, Met, His, Ile, Leu, Val Ala, or Gly
  SITE (274)..(274): Xaa at position 274 is Leu, Ala, Val, Gly, or Ile
  SITE (281)..(281): Xaa at position 281 is Tyr, Phe, Met, His, Ile, Leu, Val Ala, or Gly
  SITE (282)..(282): Xaa at position 282 is Phe, Tyr, Met, His, Ile, Leu, Val Ala, or Gly
  SITE (318)..(318): Xaa at position 318 is Ile, Ala, Val, Leu, or Gly
  SITE (320)..(320): Xaa at position 320 is Met, Ile, Leu, Val, Ala, or Gly
  SITE (324)..(324): Xaa at position 324 is Met, Ile, Leu, Val, Ala, or Gly
  SITE (327)..(327): Xaa at position 327 is Ile, Ala, Val, Leu, or Gly
  SITE (337)..(337): Xaa at position 337 is Leu, Ala, Val, Gly, or Ile
  SITE (340)..(340): Xaa at position 340 is Val, Ala, Gly, Leu, or Ile
  SITE (341)..(341): Xaa at position 341 is Val, Ala, Gly, Leu, or Ile
  SITE (342)..(342): Xaa at position 342 is Ala, Gly, or Pro
  SITE (344)..(344): Xaa at position 344 is Val, Ala, Gly, Leu, or Ile
  SITE (345)..(345): Xaa at position 345 is Leu, Ala, Val, Gly, or Ile
  SITE (347)..(347): Xaa at position 347 is Leu, Ala, Val, Gly, or Ile
  SITE (350)..(350): Xaa at position 350 is Ile, Ala, Val, Leu, or Gly
  SITE (372)..(372): Xaa at position 372 is Leu, Ala, Val, Gly, or Ile
  SITE (375)..(375): Xaa at position 375 is Cys, Ala, Val, Gly, Ser, or Thr
  SITE (376)..(376): Xaa at position 376 is Ala, Gly, or Pro
  SITE (378)..(378): Xaa at position 378 is Leu, Ala, Val, Gly, or Ile
  SITE (379)..(379): Xaa at position 379 is Leu, Ala, Val, Gly, or Ile
  SITE (381)..(381): Xaa at position 381 is Leu, Ala, Val, Gly, or Ile
  SITE (386)..(386): Xaa at position 386 is Leu, Ala, Val, Gly, or Ile
  SITE (390)..(390): Xaa at position 390 is Leu, Ala, Val, Gly, or Ile
  SITE (416)..(416): Xaa at position 416 is Ala, Gly, or Pro
  SITE (419)..(419): Xaa at position 419 is Ala, Gly, or Pro
  SITE (422)..(422): Xaa at position 422 is Ala, Gly, or Pro
  SITE (423)..(423): Xaa at position 423 is Leu, Ala, Val, Gly, or Ile
  SITE (424)..(424): Xaa at position 424 is Ala, Gly, or Pro
  SITE (427)..(427): Xaa at position 427 is Val, Ala, Gly, Leu, or Ile
  SITE (428)..(428): Xaa at position 428 is Tyr, Phe, Met, His, Ile, Leu, Val Ala, or Gly
  SITE (431)..(431): Xaa at position 431 is Leu, Ala, Val, Gly, or Ile
  SITE (432)..(432): Xaa at position 432 is Phe, Tyr, Met, His, Ile, Leu, Val Ala, or Gly
  SITE (435)..(435): Xaa at position 435 is Val, Ala, Gly, Leu, or Ile
  SITE (436)..(436): Xaa at position 436 is Val, Ala, Gly, Leu, or Ile
  SITE (439)..(439): Xaa at position 439 is Val, Ala, Gly, Leu, or Ile
  SITE (452)..(452): Xaa at position 452 is Ile, Ala, Val, Leu, or Gly
  SITE (454)..(454): Xaa at position 454 is Val, Ala, Gly, Leu, or Ile
  SITE (455)..(455): Xaa at position 455 is Leu, Ala, Val, Gly, or Ile
  SITE (471)..(471): Xaa at position 471 is Phe, Tyr, Met, His, Ile, Leu, Val Ala, or Gly
  SITE (475)..(475): Xaa at position 475 is Tyr, Phe, Met, His, Ile, Leu, Val Ala, or Gly
  SITE (476)..(476): Xaa at position 476 is Cys, Ala, Val, Gly, Ser, or Thr
  SITE (480)..(480): Xaa at position 480 is Leu, Ala, Val, Gly, or Ile
  SITE (483)..(483): Xaa at position 483 is Phe, Tyr, Met, His, Ile, Leu, Val Ala, or Gly
  SITE (484)..(484): Xaa at position 484 is Phe, Tyr, Met, His, Ile, Leu, Val Ala, or Gly
  SITE (488)..(488): Xaa at position 488 is Ile, Ala, Val, Leu, or Gly
  SITE (489)..(489): Xaa at position 489 is Leu, Ala, Val, Gly, or Ile
  SITE (496)..(496): Xaa at position 496 is Tyr, Phe, Met, His, Ile, Leu, Val Ala, or Gly
  SITE (514)..(514): Xaa at position 514 is Cys, Ala, Val, Gly, Ser, or Thr
  SITE (515)..(515): Xaa at position 515 is Ile, Ala, Val, Leu, or Gly
  SITE (517)..(517): Xaa at position 517 is Leu, Ala, Val, Gly, or Ile
  SITE (518)..(518): Xaa at position 518 is Ile, Ala, Val, Leu, or Gly
  SITE (525)..(525): Xaa at position 525 is Ile, Ala, Val, Leu, or Gly
  SITE (528)..(528): Xaa at position 528 is Ile, Ala, Val, Leu, or Gly
  SITE (529)..(529): Xaa at position 529 is Leu, Ala, Val, Gly, or Ile
  SITE (543)..(543): Xaa at position 543 is Phe, Tyr, Met, His, Ile, Leu, Val Ala, or Gly
  SITE (547)..(547): Xaa at position 547 is Val, Ala, Gly, Leu, or Ile
  SITE (577)..(577): Xaa at position 577 is Phe, Tyr, Met, His, Ile, Leu, Val Ala, or Gly
  SITE (578)..(578): Xaa at position 578 is Ile, Ala, Val, Leu, or Gly
  SITE (579)..(579): Xaa at position 579 is Ile, Ala, Val, Leu, or Gly
  SITE (586)..(586): Xaa at position 586 is Val, Ala, Gly, Leu, or Ile
  SITE (588)..(588): Xaa at position 588 is Tyr, Phe, Met, His, Ile, Leu, Val Ala, or Gly
  SITE (593)..(593): Xaa at position 593 is Phe, Tyr, Met, His, Ile, Leu, Val Ala, or Gly
  SITE (605)..(605): Xaa at position 605 is Leu, Ala, Val, Gly, or Ile
  SITE (609)..(609): Xaa at position 609 is Ile, Ala, Val, Leu, or Gly
  SITE (617)..(617): Xaa at position 617 is Ile, Ala, Val, Leu, or Gly
  SITE (651)..(651): Xaa at position 651 is Leu, Ala, Val, Gly, or Ile
  SITE (654)..(654): Xaa at position 654 is Leu, Ala, Val, Gly, or Ile
  SITE (655)..(655): Xaa at position 655 is Leu, Ala, Val, Gly, or Ile
  SITE (658)..(658): Xaa at position 658 is Leu, Ala, Val, Gly, or Ile
  SITE (665)..(665): Xaa at position 665 is Phe, Tyr, Met, His, Ile, Leu, Val Ala, or Gly
  SITE (666)..(666): Xaa at position 666 is Ile, Ala, Val, Leu, or Gly
  SITE (668)..(668): Xaa at position 668 is Cys, Ala, Val, Gly, Ser, or Thr
  SITE (669)..(669): Xaa at position 669 is Ile, Ala, Val, Leu, or Gly
  SITE (685)..(685): Xaa at position 685 is Ile, Ala, Val, Leu, or Gly
  SITE (689)..(689): Xaa at position 689 is Leu, Ala, Val, Gly, or Ile
  SITE (694)..(694): Xaa at position 694 is Met, Ile, Leu, Val, Ala, or Gly
  SITE (697)..(697): Xaa at position 697 is Val, Ala, Gly, Leu, or Ile
  SITE (698)..(698): Xaa at position 698 is Leu, Ala, Val, Gly, or Ile
  SITE (701)..(701): Xaa at position 701 is Met, Ile, Leu, Val, Ala, or Gly
  SITE (705)..(705): Xaa at position 705 is Tyr, Phe, Met, His, Ile, Leu, Val Ala, or Gly
  SITE (709)..(709): Xaa at position 709 is Ala, Gly, or Pro
  SITE (714)..(714): Xaa at position 714 is Leu, Ala, Val, Gly, or Ile
  SITE (718)..(718): Xaa at position 718 is Tyr, Phe, Met, His, Ile, Leu, Val Ala, or Gly
  SITE (721)..(721): Xaa at position 721 is Tyr, Phe, Met, His, Ile, Leu, Val Ala, or Gly
  SITE (729)..(729): Xaa at position 729 is Leu, Ala, Val, Gly, or Ile
  SITE (734)..(734): Xaa at position 734 is Phe, Tyr, Met, His, Ile, Leu, Val Ala, or Gly
  SITE (735)..(735): Xaa at position 735 is Cys, Ala, Val, Gly, Ser, or Thr
  SITE (737)..(737): Xaa at position 737 is Ala, Gly, or Pro
  SITE (738)..(738): Xaa at position 738 is Leu, Ala, Val, Gly, or Ile
  SITE (739)..(739): Xaa at position 739 is Phe, Tyr, Met, His, Ile, Leu, Val Ala, or Gly
  SITE (753)..(753): Xaa at position 753 is Leu, Ala, Val, Gly, or Ile
  SITE (756)..(756): Xaa at position 756 is Val, Ala, Gly, Leu, or Ile
  SITE (757)..(757): Xaa at position 757 is Phe, Tyr, Met, His, Ile, Leu, Val Ala, or Gly
  SITE (758)..(758): Xaa at position 758 is Phe, Tyr, Met, His, Ile, Leu, Val Ala, or Gly
  SITE (763)..(763): Xaa at position 763 is Phe, Tyr, Met, His, Ile, Leu, Val Ala, or Gly
  SITE (764)..(764): Xaa at position 764 is Ala, Gly, or Pro
  SITE (769)..(769): Xaa at position 769 is Ile, Ala, Val, Leu, or Gly
  SITE (777)..(777): Xaa at position 777 is Leu, Ala, Val, Gly, or Ile
  SITE (780)..(780): Xaa at position 780 is Leu, Ala, Val, Gly, or Ile
  SITE (784)..(784): Xaa at position 784 is Val, Ala, Gly, Leu, or Ile
  SITE (1171)..(1171): Xaa at position 1171 is Ile, Ala, Val, Leu, or Gly
  SITE (1180)..(1180): Xaa at position 1180 is Phe, Tyr, Met, His, Ile, Leu Val, Ala, or Gly
  SITE (1204)..(1204): Xaa at position 1204 is Ala, Gly, or Pro
  SITE (1205)..(1205): Xaa at position 1205 is His, Phe, Tyr, Lys, Arg, Gly Ser, Thr, Ala, Val, Leu, Ile, Asn, Met, or Gln
  SITE (1206)..(1206): Xaa at position 1206 is Phe, Tyr, Met, His, Ile, Leu Val, Ala, or Gly
  SITE (1212)..(1212): Xaa at position 1212 is Ala, Gly, or Pro
  SITE (1215)..(1215): Xaa at position 1215 is Met, Ile, Leu, Val, Ala, or Gly
  SITE (1226)..(1226): Xaa at position 1226 is Leu, Ala, Val, Gly, or Ile
  SITE (1227)..(1227): Xaa at position 1227 is Val, Ala, Gly, Leu, or Ile
  SITE (1235)..(1235): Xaa at position 1235 is Met, Ile, Leu, Val, Ala, or Gly
  SITE (1245)..(1245): Xaa at position 1245 is Leu, Ala, Val, Gly, or Ile
  SITE (1258)..(1258): Xaa at position 1258 is Phe, Tyr, Met, His, Ile, Leu Val, Ala, or Gly
  SITE (1262)..(1262): Xaa at position 1262 is Trp, Tyr, Phe, Met, His, Ile Leu, Val, Ala, or Gly
  SITE (1271)..(1271): Xaa at position 1271 is Leu, Ala, Val, Gly, or Ile
  SITE (1274)..(1274): Xaa at position 1274 is Ala, Gly, or Pro
  SITE (1275)..(1275): Xaa at position 1275 is Ile, Ala, Val, Leu, or Gly
  SITE (1280)..(1280): Xaa at position 1280 is Ala, Gly, or Pro
  SITE (1285)..(1285): Xaa at position 1285 is Ala, Gly, or Pro
  SITE (1289)..(1289): Xaa at position 1289 is Leu, Ala, Val, Gly, or Ile
MEDGKPVWXPHPTDGFQMGNIVDIGPDSLTXEPLNQKGKTFLXLINQVFPAEEDSKKDVEDNXSXMYLNEXTXXHNXKVRYSKDRXYTYXANXXXXVNPYFDXPKIYSSEAXKSYQGKSLGTRPPHXXXXXDKXFRDXKXLKMSQSXXXSGESGXGKTENTKFXLRXXTESYGTGQDIDDRIVEXNPXXEXXGNXKTVRNNNSSRXGKXVEXHXNEKSSXVGGFVSHYLLEKSRXCVQGKEERNXXXXXRXXAGASEDIREKLHXSSPDNXRXXNRGCTRXXANKETDKQILQNRKSPEYLKAGSMKDPLLDDHGDFXRXCTAXKKXGLDDEEKLDXFRXXXGXXHXGNXDFEEAGSTSGGCNLKNKSAQSXEYXXEXXGXDQDDXRVSXTTRVMLTTAGGTKGTVIKVPLKVEQXNNXRDXXXKTXXSHXXDHXXNRXNQCFPFETSSYFXGXXDIAGFEYFEHNSFEQXCINXXNEKXQQXXNERXXKEEQELXQKEGLGVNEVHYVDNQDXXDXXEAKLVGXLDXXDEENRLPQPSDQHXTSAXHQKHKDHFRLTIPRKSKLAVHRNIRDDEGXXXRHFAGAXCXETTQXVEKNNDALHMSXESLXCESRDKFXRELFESSTNNNKDTKQKAGKLSFISVGNKFKTQXNLXXDKXRSTGASXXRXXKPNLKMTSHHFEGAQXLSQXQCSGXVSXXDLXQGGXPSRXSFHEXYNMXKKXMPDKLARXDPRLXXKXXXKALGLNENDYKFGXTKXXXRPGKXXEFDQXMKSDPDHXAEXVKRXNHWLTCSRWKKVQWCSLSVIKLKNKIKYRAEACIKMQKTIRMWLCKRRHKPRIDGLVKVGTLKKRLDKFNEVVSVLKDGKPEMNKQIKNLEISIDTLMAKIKSTMMTQEQIQKEYDALVKSSEELLSALQKKKQQEEEAERLRRIQEEMEKERKRREEDEKRRRKEEEERRMKLEMEAKRKQEEEERKKREDDEKRIQAEVEAQLARQKEEESQQQAVLEQERRDRELALRIAQSEAELISDEAQADLALRRSLDSYPVSKNDGTRPKMTPEQMAKEMSEFLSRGPAVLATKAAAGTKKYDLSKWKYAELRDTINTSCDIELLAACREEFHRRLKVYHAWKSKNKKRNTETEQRAPKSVTDYDFAPFLNNSPQQNPAAQIPARQREXEMNRQQRFXRIPFIRPADQYKDPQSKKKGWWYXXXDGPWIXRQXELHPDKPPILXXAGKDDMEXCELNLEETGXTRKRGAEILPRQXEEIXERCGGIQYXQNXXESRQXRPTYXTAMXQSLLK

SEQ ID NO: 902 - protein, 814 aa, Homo sapiens
  SITE (761)..(761): Xaa at position 761 is Ala, Gly, or Pro
  SITE (763)..(763): Xaa at position 763 is Ala, Gly, or Pro
  SITE (775)..(775): Xaa at position 775 is Leu, Ala, Val, Gly, or Ile
  SITE (783)..(783): Xaa at position 783 is Phe, Tyr, Met, His, Ile, Leu, Val Ala, or Gly
  SITE (786)..(786): Xaa at position 786 is Val, Ala, Gly, Leu, or Ile
  SITE (795)..(795): Xaa at position 795 is Leu, Ala, Val, Gly, or Ile
  SITE (806)..(806): Xaa at position 806 is Ile, Ala, Val, Leu, or Gly
MGLPALEFSDCCLDSPHFRETLKSHEAELDKTNKFIKELIKDGKSLISALKNLSSAKRKFADSLNEFKFQCIGDAETDDEMCIARSLQEFATVLRNLEDERIRMIENASEVLITPLEKFRKEQIGAAKEAKKKYDKETEKYCGILEKHLNLSSKKKESQLQEADSQVDLVRQHFYEVSLEYVFKVQEVQERKMFEFVEPLLAFLQGLFTFYHHGYELAKDFGDFKTQLTISIQNTRNRFEGTRSEVESLMKKMKENPLEHKTISPYTMEGYLYVQEKRHFGTSWVKHYCTYQRDSKQITMVPFDQKSGGKGGEDESVILKSCTRRKTDSIEKRFCFDVEAVDRPGVITMQALSEEDRRLWMEAMDGREPVYNSNKDSQSEGTAQLDSIGFSIIRKCIHAVETRGINEQGLYRIVGVNSRVQKLLSVLMDPKTASETETDICAEWEIKTITSALKTYLRMLPGPLMMYQFQRSFIKAAKLENQESRVSEIHSLVHRLPEKNRQMLQLLMNHLANVANNHKQNLMTVANLGVVFGPTLLRPQEETVAAIMDIKFQNIVIEILIENHEKIFNTVPDMPLTNAQLHLSRKKSSDSKPPSCSERPLTLFHTVQSTEKQEQRNSIINSSLESVSSNPNSILNSSSSLQPNMNSSDPDLAVVKPTRPNSLPPNPSPTSPLSPSWPMFSAPSSPMPTSSTSSDSSPVRSVAGFVWFSVAAVVLSLARSSLHAVFSLLVNFVPCHPNLHLLFDRPEEAVHEDSSTPFRKXKXLYACKAEHDSEXSFTAGTVXDNXHPSQEPGWXEGTLNGKTGLXPENYVEFL

SEQ ID NO: 903 - protein, 199 aa, Homo sapiens
  SITE (82)..(82): Xaa at position 82 is Ala, Gly, or Pro
  SITE (84)..(84): Xaa at position 84 is Phe, Tyr, Met, His, Ile, Leu, Val Ala, or Gly
  SITE (100)..(100): Xaa at position 100 is Cys, Ala, Val, Gly, Ser, or Thr
  SITE (101)..(101): Xaa at position 101 is Val, Ala, Gly, Leu, or Ile
  SITE (109)..(109): Xaa at position 109 is Leu, Ala, Val, Gly, or Ile
  SITE (111)..(111): Xaa at position 111 is Ile, Ala, Val, Leu, or Gly
  SITE (117)..(117): Xaa at position 117 is Tyr, Phe, Met, His, Ile, Leu, Val Ala, or Gly
  SITE (119)..(119): Xaa at position 119 is Ile, Ala, Val, Leu, or Gly
  SITE (123)..(123): Xaa at position 123 is Val, Ala, Gly, Leu, or Ile
  SITE (124)..(124): Xaa at position 124 is Ala, Gly, or Pro
  SITE (137)..(137): Xaa at position 137 is Val, Ala, Gly, Leu, or Ile
  SITE (139)..(139): Xaa at position 139 is Leu, Ala, Val, Gly, or Ile
  SITE (140)..(140): Xaa at position 140 is Tyr, Phe, Met, His, Ile, Leu, Val Ala, or Gly
  SITE (155)..(155): Xaa at position 155 is Ile, Ala, Val, Leu, or Gly
  SITE (158)..(158): Xaa at position 158 is Val, Ala, Gly, Leu, or Ile
  SITE (164)..(164): Xaa at position 164 is Leu, Ala, Val, Gly, or Ile
  SITE (170)..(170): Xaa at position 170 is Ile, Ala, Val, Leu, or Gly
  SITE (172)..(172): Xaa at position 172 is Leu, Ala, Val, Gly, or Ile
  SITE (180)..(180): Xaa at position 180 is Val, Ala, Gly, Leu, or Ile
  SITE (187)..(187): Xaa at position 187 is Trp, Tyr, Phe, Met, His, Ile, Leu Val, Ala, or Gly
  SITE (189)..(189): Xaa at position 189 is Ile, Ala, Val, Leu, or Gly
MTLHPSPITCEFLFSTALISPKMCLSHLENMPLSHSRTQGAQRSSWKLWLFCSIVMLLFLCSFSWLIFIFLQLETAKEPCMXKXGPLPSKWQMASSEPPXXNKVSDWKXEXLQNGLXLXYGQXXPNANYNDVAPFEXRXXKNKDMIQTLTNKSKXQNXGGTYEXHVGDTXDXIFNSEHQXLKNNTYXGXILLANPQFIS

SEQ ID NO: 904 - protein, 1703 aa, Homo sapiens
  SITE (1494)..(1494): Xaa at position 1494 is Leu, Ala, Val, Gly, or Ile
  SITE (1500)..(1500): Xaa at position 1500 is Leu, Ala, Val, Gly, or Ile
MSLLCVGVKKAKFDGAQEKFNTYVTLKVQNVKSTTIAVRGSQPSWEQDFMFEINRLDLGLTVEVWNKGLIWDTMVGTVWIPLRTIRQSNEEGPGEWLTLDSQVIMADSEICGTKDPTFHRILLDTRFELPLDIPEEEARYWAKKLEQLNAMRDQDEYSFQDEQDKPLPVPSNQCCNWNYFGWGEQHNDDPDSAVDDRDSDYRSETSNSIPPPYYTTSQPNASVHQYSVRPPPLGSRESYSDSMHSYEEFSEPQALSPTGSSRYASSGELSQGSSQLSEDFDPDEHSLQGSDMEDERDRDSYHSCHSSVSYHKDSPRWDQDEEELEEDLEDFLEEEELPEDEEELEEEEEEVPDDLGSYAQREDVAVAEPKDFKRISLPPAAPGKEDKAPVAPTEAPDMAKVAPKPATPDKVPAAEQIPEAEPPKDEESFRPREDEEGQEGQDSMSRAKANWLRAFNKVRMQLQEARGEGEMSKSLWFKGGPGGGLIIIDSMPDIRKRKPIPLVSDLAMSLVQSRKAGITSALASSTLNNEELKNHVYKKTLQALIYPISCTTPHNFEVWTATTPTYCYECEGLLWGIARQGMRCTECGVKCHEKCQDLLNADCLQRAAEKSSKHGAEDRTQNIIMVLKDRMKIRERNKPEIFELIQEIFAVTKTAHTQQMKAVKQSVLDGTSKWSAKISITVVCAQGLQAKDKTGSSDPYVTVQVGKTKKRTKTIYGNLNPVWEENFHFECHNSSDRIKVRVWDEDDDIKSRVKQRFKRESDDFLGQTIIEVRTLSGEMDVWYNLDKRTDKSAVSGAIRLHISVEIKGEEKVAPYHVQYTCLHENLFHFVTDVQNNGVVKIPDAKGDDAWKVYYDETAQEIVDEFAMRYGVESIYQAMTHFACLSSKYMCPGVPAVMSTLLANINAYYAHTTASTNVSASDRFAASNFGKERFVKLLDQLHNSLRIDLSMYRNNFPASSPERLQDLKSTVDLLTSITFFRMKVQELQSPPRASQVVKDCVKACLNSTYEYIFNNCHELYSREYQTDPAKKGEVLPEEQGPSIKNLDFWSKLITLIVSIIEEDKNSYTPCLNQFPQELNVGKISAEVMWNLFAQDMKYAMEEHDKHRLCKSADYMNLHFKVKWLYNEYVTELPAFKDRVPEYPAWFEPFVIQWLDENEEVSRDFLHGALERDKKDGFQQTSEHALFSCSVVDVFSQLNQSFEIIKKLECPDPQIVGHYMRRFAKTISNVLLQYADIISKDFASYCSKEKEKVPCILMNNTQQLRVQLEKMFEAMGGKELDAEASDILKELQVKLNNVLDELSRVFATSFQPHIEECVKQMGDILSQVKGTGNVPASACSSVAQDADNVLQPIMDLLDSNLTLFAKICEKTVLKRVLKELWKLVMNTMEKTIVLPPLTDQTMIGNLLRKHGKGLEKGRVKLPSHSDGTQMIFNAAKELGQLSKLKDHMVREEAKSLTPKQCAVVELALDTIKQYFHAGGVGLKKTFLEKSPDLQSXRYALSXYTQATDLLIKTFVQTQSAQGLGVEDPVGEVSVHVELFTHPGTGEHKVTVKVVAANDLKWQTSGIFRPFIEVNIIGPQLSDKKRKFATKSKNNSWAPKYNESFQFTLSADAGPECYELQVCVKDYCFAREDRTVGLAVLQLRELAQRGSAACWLPLGRRIHMDDTGLTVLRILSQRSNDEVAKEFVKLKSDTRSAEEGGAAPAP

SEQ ID NO: 905 - protein, 450 aa, Influenza A virus
  strain A/Hong Kong/156/1997 H5N1 genotype Gs/Gd
  SITE (87)..(87): Xaa at position 87 is Ile, Ala, Val, Leu, or Gly
  SITE (95)..(95): Xaa at position 95 is Val, Ala, Gly, Leu, or Ile
  SITE (97)..(97): Xaa at position 97 is Val, Ala, Gly, Leu, or Ile
  SITE (102)..(102): Xaa at position 102 is Phe, Tyr, Met, His, Ile, Leu, Val Ala, or Gly
  SITE (103)..(103): Xaa at position 103 is Ile, Ala, Val, Leu, or Gly
  SITE (113)..(113): Xaa at position 113 is Phe, Tyr, Met, His, Ile, Leu, Val Ala, or Gly
  SITE (114)..(114): Xaa at position 114 is Phe, Tyr, Met, His, Ile, Leu, Val Ala, or Gly
  SITE (115)..(115): Xaa at position 115 is Leu, Ala, Val, Gly, or Ile
  SITE (139)..(139): Xaa at position 139 is Leu, Ala, Val, Gly, or Ile
  SITE (142)..(142): Xaa at position 142 is Cys, Ala, Val, Gly, Ser, or Thr
  SITE (159)..(159): Xaa at position 159 is Ala, Gly, or Pro
  SITE (160)..(160): Xaa at position 160 is Trp, Tyr, Phe, Met, His, Ile, Leu Val, Ala, or Gly
  SITE (162)..(162): Xaa at position 162 is Ala, Gly, or Pro
  SITE (164)..(164): Xaa at position 164 is Ala, Gly, or Pro
  SITE (165)..(165): Xaa at position 165 is Cys, Ala, Val, Gly, Ser, or Thr
  SITE (172)..(172): Xaa at position 172 is Leu, Ala, Val, Gly, or Ile
  SITE (174)..(174): Xaa at position 174 is Ile, Ala, Val, Leu, or Gly
  SITE (176)..(176): Xaa at position 176 is Ile, Ala, Val, Leu, or Gly
  SITE (183)..(183): Xaa at position 183 is Ala, Gly, or Pro
  SITE (184)..(184): Xaa at position 184 is Val, Ala, Gly, Leu, or Ile
  SITE (185)..(185): Xaa at position 185 is Ala, Gly, or Pro
  SITE (187)..(187): Xaa at position 187 is Leu, Ala, Val, Gly, or Ile
  SITE (205)..(205): Xaa at position 205 is Leu, Ala, Val, Gly, or Ile
  SITE (213)..(213): Xaa at position 213 is Ala, Gly, or Pro
  SITE (214)..(214): Xaa at position 214 is Cys, Ala, Val, Gly, Ser, or Thr
  SITE (215)..(215): Xaa at position 215 is Val, Ala, Gly, Leu, or Ile
  SITE (220)..(220): Xaa at position 220 is Phe, Tyr, Met, His, Ile, Leu, Val Ala, or Gly
  SITE (222)..(222): Xaa at position 222 is Val, Ala, Gly, Leu, or Ile
  SITE (223)..(223): Xaa at position 223 is Met, Ile, Leu, Val, Ala, or Gly
  SITE (232)..(232): Xaa at position 232 is Ala, Gly, or Pro
  SITE (234)..(234): Xaa at position 234 is Tyr, Phe, Met, His, Ile, Leu, Val Ala, or Gly
  SITE (236)..(236): Xaa at position 236 is Ile, Ala, Val, Leu, or Gly
  SITE (239)..(239): Xaa at position 239 is Ile, Ala, Val, Leu, or Gly
  SITE (244)..(244): Xaa at position 244 is Val, Ala, Gly, Leu, or Ile
  SITE (256)..(256): Xaa at position 256 is His, Phe, Tyr, Lys, Arg, Gly, Ser Thr, Ala, Val, Leu, Ile, Asn, Met, or Gln
  SITE (257)..(257): Xaa at position 257 is Tyr, Phe, Met, His, Ile, Leu, Val Ala, or Gly
  SITE (260)..(260): Xaa at position 260 is Cys, Ala, Val, Gly, Ser, or Thr
  SITE (262)..(262): Xaa at position 262 is Cys, Ala, Val, Gly, Ser, or Thr
  SITE (263)..(263): Xaa at position 263 is Tyr, Phe, Met, His, Ile, Leu, Val Ala, or Gly
  SITE (266)..(266): Xaa at position 266 is Ala, Gly, or Pro
  SITE (269)..(269): Xaa at position 269 is Ile, Ala, Val, Leu, or Gly
  SITE (271)..(271): Xaa at position 271 is Cys, Ala, Val, Gly, Ser, or Thr
  SITE (272)..(272): Xaa at position 272 is Val, Ala, Gly, Leu, or Ile
  SITE (273)..(273): Xaa at position 273 is Cys, Ala, Val, Gly, Ser, or Thr
  SITE (285)..(285): Xaa at position 285 is Val, Ala, Gly, Leu, or Ile
  SITE (287)..(287): Xaa at position 287 is Phe, Tyr, Met, His, Ile, Leu, Val Ala, or Gly
  SITE (299)..(299): Xaa at position 299 is Cys, Ala, Val, Gly, Ser, or Thr
  SITE (302)..(302): Xaa at position 302 is Val, Ala, Gly, Leu, or Ile
  SITE (303)..(303): Xaa at position 303 is Phe, Tyr, Met, His, Ile, Leu, Val Ala, or Gly
  SITE (330)..(330): Xaa at position 330 is Phe, Tyr, Met, His, Ile, Leu, Val Ala, or Gly
  SITE (332)..(332): Xaa at position 332 is Phe, Tyr, Met, His, Ile, Leu, Val Ala, or Gly
  SITE (334)..(334): Xaa at position 334 is Tyr, Phe, Met, His, Ile, Leu, Val Ala, or Gly
  SITE (338)..(338): Xaa at position 338 is Val, Ala, Gly, Leu, or Ile
  SITE (339)..(339): Xaa at position 339 is Trp, Tyr, Phe, Met, His, Ile, Leu Val, Ala, or Gly
  SITE (340)..(340): Xaa at position 340 is Ile, Ala, Val, Leu, or Gly
  SITE (352)..(352): Xaa at position 352 is Phe, Tyr, Met, His, Ile, Leu, Val Ala, or Gly
  SITE (354)..(354): Xaa at position 354 is Met, Ile, Leu, Val, Ala, or Gly
  SITE (355)..(355): Xaa at position 355 is Ile, Ala, Val, Leu, or Gly
  SITE (368)..(368): Xaa at position 368 is Phe, Tyr, Met, His, Ile, Leu, Val Ala, or Gly
  SITE (374)..(374): Xaa at position 374 is Ile, Ala, Val, Leu, or Gly
  SITE (375)..(375): Xaa at position 375 is Ile, Ala, Val, Leu, or Gly
  SITE (387)..(387): Xaa at position 387 is Phe, Tyr, Met, His, Ile, Leu, Val Ala, or Gly
  SITE (388)..(388): Xaa at position 388 is Ile, Ala, Val, Leu, or Gly
  SITE (399)..(399): Xaa at position 399 is Met, Ile, Leu, Val, Ala, or Gly
  SITE (402)..(402): Xaa at position 402 is Cys, Ala, Val, Gly, Ser, or Thr
  SITE (403)..(403): Xaa at position 403 is Phe, Tyr, Met, His, Ile, Leu, Val Ala, or Gly
  SITE (404)..(404): Xaa at position 404 is Trp, Tyr, Phe, Met, His, Ile, Leu Val, Ala, or Gly
  SITE (405)..(405): Xaa at position 405 is Val, Ala, Gly, Leu, or Ile
  SITE (407)..(407): Xaa at position 407 is Leu, Ala, Val, Gly, or Ile
  SITE (418)..(418): Xaa at position 418 is Trp, Tyr, Phe, Met, His, Ile, Leu Val, Ala, or Gly
  SITE (424)..(424): Xaa at position 424 is Ile, Ala, Val, Leu, or Gly
  SITE (426)..(426): Xaa at position 426 is Phe, Tyr, Met, His, Ile, Leu, Val Ala, or Gly
MNPNQKIITIGSICMVVGIISLMLQIGNIISVWVSHIIQTWHPNQPEPCNQSINFYTEQAAASVTLAGNSSLCPISGWAIYSKDNSXRIGSKGDXFXIREPXXSCSHLECRTXXXTQGALLNDKHSNGTVKDRSPYRTXMSXPVGEAPSPYNSRFESVXXSXSXXHDGISWXTXGXSGPDNGXXXVXKYNGIITDTIKSWRNNIXRTQESECXXXNGSCXTXXTDGPSNEQXSXKXFKXEKGRXVKSVELNAPNYXXEEXSXXPDXGEXTXXXRDNWHGSNRPWXSXNQNLEYQIGYIXSGXXGDSPRPNDGTGSCGPVSLNGAYGVKGXSXKXGNGXXXGRTKSTSSRSGXEXXWDPNGWTETDSSXSLKQDXXAITDWSGYSGSXXQHPELTGLNCXRPXXXXEXIRGRPKEKTIXTSGSSXSXCGVNSDTVGWSWPDGADLPFTIDK

SEQ ID NO: 906 - protein, 566 aa, Influenza A virus
  strain A/Brevig Mission/1/1918 H1N1 (Influenza A virus (strain A/South Carolina/1/1918 H1N1))
  SITE (7)..(7): Xaa at position 7 is Val, Ala, Gly, Leu, or Ile
  SITE (20)..(20): Xaa at position 20 is Ile, Ala, Val, Leu, or Gly
  SITE (21)..(21): Xaa at position 21 is Cys, Ala, Val, Gly, Ser, or Thr
  SITE (22)..(22): Xaa at position 22 is Ile, Ala, Val, Leu, or Gly
  SITE (26)..(26): Xaa at position 26 is Ala, Gly, or Pro
  SITE (33)..(33): Xaa at position 33 is Val, Ala, Gly, Leu, or Ile
  SITE (36)..(36): Xaa at position 36 is Val, Ala, Gly, Leu, or Ile
  SITE (43)..(43): Xaa at position 43 is Val, Ala, Gly, Leu, or Ile
  SITE (49)..(49): Xaa at position 49 is Leu, Ala, Val, Gly, or Ile
  SITE (50)..(50): Xaa at position 50 is Leu, Ala, Val, Gly, or Ile
  SITE (58)..(58): Xaa at position 58 is Leu, Ala, Val, Gly, or Ile
  SITE (59)..(59): Xaa at position 59 is Cys, Ala, Val, Gly, Ser, or Thr
  SITE (61)..(61): Xaa at position 61 is Leu, Ala, Val, Gly, or Ile
  SITE (67)..(67): Xaa at position 67 is Leu, Ala, Val, Gly, or Ile
  SITE (69)..(69): Xaa at position 69 is Leu, Ala, Val, Gly, or Ile
  SITE (72)..(72): Xaa at position 72 is Cys, Ala, Val, Gly, Ser, or Thr
  SITE (74)..(74): Xaa at position 74 is Ile, Ala, Val, Leu, or Gly
  SITE (75)..(75): Xaa at position 75 is Ala, Gly, or Pro
  SITE (77)..(77): Xaa at position 77 is Trp, Tyr, Phe, Met, His, Ile, Leu Val, Ala, or Gly
  SITE (78)..(78): Xaa at position 78 is Leu, Ala, Val, Gly, or Ile
  SITE (79)..(79): Xaa at position 79 is Leu, Ala, Val, Gly, or Ile
  SITE (84)..(84): Xaa at position 84 is Cys, Ala, Val, Gly, Ser, or Thr
  SITE (87)..(87): Xaa at position 87 is Leu, Ala, Val, Gly, or Ile
  SITE (93)..(93): Xaa at position 93 is Trp, Tyr, Phe, Met, His, Ile, Leu Val, Ala, or Gly
  SITE (95)..(95): Xaa at position 95 is Tyr, Phe, Met, His, Ile, Leu, Val Ala, or Gly
  SITE (96)..(96): Xaa at position 96 is Ile, Ala, Val, Leu, or Gly
  SITE (97)..(97): Xaa at position 97 is Val, Ala, Gly, Leu, or Ile
  SITE (107)..(107): Xaa at position 107 is Cys, Ala, Val, Gly, Ser, or Thr
  SITE (108)..(108): Xaa at position 108 is Tyr, Phe, Met, His, Ile, Leu, Val Ala, or Gly
  SITE (118)..(118): Xaa at position 118 is Leu, Ala, Val, Gly, or Ile
  SITE (122)..(122): Xaa at position 122 is Leu, Ala, Val, Gly, or Ile
  SITE (125)..(125): Xaa at position 125 is Val, Ala, Gly, Leu, or Ile
  SITE (128)..(128): Xaa at position 128 is Phe, Tyr, Met, His, Ile, Leu, Val Ala, or Gly
  SITE (134)..(134): Xaa at position 134 is Phe, Tyr, Met, His, Ile, Leu, Val Ala, or Gly
  SITE (151)..(151): Xaa at position 151 is Ala, Gly, or Pro
  SITE (152)..(152): Xaa at position 152 is Ala, Gly, or Pro
  SITE (153)..(153): Xaa at position 153 is Cys, Ala, Val, Gly, Ser, or Thr
  SITE (155)..(155): Xaa at position 155 is Tyr, Phe, Met, His, Ile, Leu, Val Ala, or Gly
  SITE (158)..(158): Xaa at position 158 is Ala, Gly, or Pro
  SITE (165)..(165): Xaa at position 165 is Leu, Ala, Val, Gly, or Ile
  SITE (166)..(166): Xaa at position 166 is Leu, Ala, Val, Gly, or Ile
  SITE (167)..(167): Xaa at position 167 is Trp, Tyr, Phe, Met, His, Ile, Leu Val, Ala, or Gly
  SITE (168)..(168): Xaa at position 168 is Leu, Ala, Val, Gly, or Ile
  SITE (175)..(175): Xaa at position 175 is Tyr, Phe, Met, His, Ile, Leu, Val Ala, or Gly
  SITE (178)..(178): Xaa at position 178 is Leu, Ala, Val, Gly, or Ile
  SITE (190)..(190): Xaa at position 190 is Val, Ala, Gly, Leu, or Ile
  SITE (191)..(191): Xaa at position 191 is Leu, Ala, Val, Gly, or Ile
  SITE (192)..(192): Xaa at position 192 is Val, Ala, Gly, Leu, or Ile
  SITE (193)..(193): Xaa at position 193 is Leu, Ala, Val, Gly, or Ile
  SITE (194)..(194): Xaa at position 194 is Trp, Tyr, Phe, Met, His, Ile, Leu Val, Ala, or Gly
  SITE (196)..(196): Xaa at position 196 is Val, Ala, Gly, Leu, or Ile
  SITE (197)..(197): Xaa at position 197 is His, Phe, Tyr, Lys, Arg, Gly, Ser Thr, Ala, Val, Leu, Ile, Asn, Met, or Gln
  SITE (198)..(198): Xaa at position 198 is His, Phe, Tyr, Lys, Arg, Gly, Ser Thr, Ala, Val, Leu, Ile, Asn, Met, or Gln
  SITE (209)..(209): Xaa at position 209 is Tyr, Phe, Met, His, Ile, Leu, Val Ala, or Gly
  SITE (215)..(215): Xaa at position 215 is Tyr, Phe, Met, His, Ile, Leu, Val Ala, or Gly
  SITE (216)..(216): Xaa at position 216 is Val, Ala, Gly, Leu, or Ile
  SITE (218)..(218): Xaa at position 218 is Val, Ala, Gly, Leu, or Ile
  SITE (223)..(223): Xaa at position 223 is Tyr, Phe, Met, His, Ile, Leu, Val Ala, or Gly
  SITE (233)..(233): Xaa at position 233 is Ala, Gly, or Pro
  SITE (244)..(244): Xaa at position 244 is Met, Ile, Leu, Val, Ala, or Gly
  SITE (246)..(246): Xaa at position 246 is Tyr, Phe, Met, His, Ile, Leu, Val Ala, or Gly
  SITE (247)..(247): Xaa at position 247 is Tyr, Phe, Met, His, Ile, Leu, Val Ala, or Gly
  SITE (250)..(250): Xaa at position 250 is Leu, Ala, Val, Gly, or Ile
  SITE (251)..(251): Xaa at position 251 is Leu, Ala, Val, Gly, or Ile
  SITE (257)..(257): Xaa at position 257 is Ile, Ala, Val, Leu, or Gly
  SITE (259)..(259): Xaa at position 259 is Phe, Tyr, Met, His, Ile, Leu, Val Ala, or Gly
  SITE (261)..(261): Xaa at position 261 is Ala, Gly, or Pro
  SITE (265)..(265): Xaa at position 265 is Leu, Ala, Val, Gly, or Ile
  SITE (266)..(266): Xaa at position 266 is Ile, Ala, Val, Leu, or Gly
  SITE (267)..(267): Xaa at position 267 is Ala, Gly, or Pro
  SITE (270)..(270): Xaa at position 270 is Tyr, Phe, Met, His, Ile, Leu, Val Ala, or Gly
  SITE (271)..(271): Xaa at position 271 is Ala, Gly, or Pro
  SITE (272)..(272): Xaa at position 272 is Phe, Tyr, Met, His, Ile, Leu, Val Ala, or Gly
  SITE (273)..(273): Xaa at position 273 is Ala, Gly, or Pro
  SITE (274)..(274): Xaa at position 274 is Leu, Ala, Val, Gly, or Ile
  SITE (282)..(282): Xaa at position 282 is Ile, Ala, Val, Leu, or Gly
  SITE (283)..(283): Xaa at position 283 is Ile, Ala, Val, Leu, or Gly
  SITE (292)..(292): Xaa at position 292 is Cys, Ala, Val, Gly, Ser, or Thr
  SITE (296)..(296): Xaa at position 296 is Cys, Ala, Val, Gly, Ser, or Thr
  SITE (302)..(302): Xaa at position 302 is Ala, Gly, or Pro
  SITE (303)..(303): Xaa at position 303 is Ile, Ala, Val, Leu, or Gly
  SITE (313)..(313): Xaa at position 313 is His, Phe, Tyr, Lys, Arg, Gly, Ser Thr, Ala, Val, Leu, Ile, Asn, Met, or Gln
  SITE (317)..(317): Xaa at position 317 is Ile, Ala, Val, Leu, or Gly
  SITE (324)..(324): Xaa at position 324 is Val, Ala, Gly, Leu, or Ile
  SITE (329)..(329): Xaa at position 329 is Leu, Ala, Val, Gly, or Ile
  SITE (331)..(331): Xaa at position 331 is Met, Ile, Leu, Val, Ala, or Gly
  SITE (332)..(332): Xaa at position 332 is Ala, Gly, or Pro
  SITE (349)..(349): Xaa at position 349 is Ala, Gly, or Pro
  SITE (361)..(361): Xaa at position 361 is Met, Ile, Leu, Val, Ala, or Gly
  SITE (366)..(366): Xaa at position 366 is Tyr, Phe, Met, His, Ile, Leu, Val Ala, or Gly
  SITE (388)..(388): Xaa at position 388 is Ala, Gly, or Pro
  SITE (389)..(389): Xaa at position 389 is Ile, Ala, Val, Leu, or Gly
  SITE (440)..(440): Xaa at position 440 is Ala, Gly, or Pro
  SITE (452)..(452): Xaa at position 452 is Leu, Ala, Val, Gly, or Ile
  SITE (459)..(459): Xaa at position 459 is Val, Ala, Gly, Leu, or Ile
  SITE (462)..(462): Xaa at position 462 is Leu, Ala, Val, Gly, or Ile
  SITE (466)..(466): Xaa at position 466 is Val, Ala, Gly, Leu, or Ile
  SITE (470)..(470): Xaa at position 470 is Leu, Ala, Val, Gly, or Ile
  SITE (481)..(481): Xaa at position 481 is Cys, Ala, Val, Gly, Ser, or Thr
  SITE (486)..(486): Xaa at position 486 is His, Phe, Tyr, Lys, Arg, Gly, Ser Thr, Ala, Val, Leu, Ile, Asn, Met, or Gln
  SITE (488)..(488): Xaa at position 488 is Cys, Ala, Val, Gly, Ser, or Thr
  SITE (492)..(492): Xaa at position 492 is Cys, Ala, Val, Gly, Ser, or Thr
  SITE (493)..(493): Xaa at position 493 is Met, Ile, Leu, Val, Ala, or Gly
MEARLLXLLCAFAATNADTXXXGYHXNNSTDTXDTXLEKNVTXTHSVNXXEDSHNGKXXKXKGIAPXQXGKXNXXGXXXGNPEXDLXLTASSXSXXXETSNSENGTXXPGDFIDYEEXREQXSSXSSXEKFEIXPKTSSWPNHETTKGVTXXXSXAGXSSFYRNXXXXTKKGSSXPKXSKSYVNNKGKEXXXXXGXXXPPTGTDQQSLXQNADAXXSXGSSKXNRRFTPEIAXRPKVRDQAGRXNXXWTXXEPGDTXTXEXTGNXXXPWXXXXXNRGSGSGXXTSDAPVHDXNTKXQTPHGXXNSSLPFQNIXPVTXGECPKYXRSTKXRXXTGLRNIPSIQSRGLFGXIAGFIEGGWTGXIDGWXGYHHQNEQGSGYAADQKSTQNXXDGITNKVNSVIEKMNTQFTAVGKEFNNLERRIENLNKKVDDGFLDIWTYNXELLVLLENERTXDFHDSNXRNXYEKXKSQXKNNAKEIGNGXFEFYXKXDDAXXESVRNGTYDYPKYSEESKLNREEIDGVKLESMGVYQILAIYSTVASSLVLLVSLGAISFWMCSNGSLQCRICI

SEQ ID NO: 907 - protein, 3010 aa, Hepatitis C virus
  genotype 1b (isolate Con1) (HCV)
  SITE (754)..(754): Xaa at position 754 is Leu, Ala, Val, Gly, or Ile
  SITE (1061)..(1061): Xaa at position 1061 is Val, Ala, Gly, Leu, or Ile
  SITE (1070)..(1070): Xaa at position 1070 is Leu, Ala, Val, Gly, or Ile
  SITE (1071)..(1071): Xaa at position 1071 is Ala, Gly, or Pro
  SITE (1073)..(1073): Xaa at position 1073 is Cys, Ala, Val, Gly, Ser, or Thr
  SITE (1074)..(1074): Xaa at position 1074 is Val, Ala, Gly, Leu, or Ile
  SITE (1077)..(1077): Xaa at position 1077 is Val, Ala, Gly, Leu, or Ile
  SITE (1078)..(1078): Xaa at position 1078 is Cys, Ala, Val, Gly, Ser, or Thr
  SITE (1079)..(1079): Xaa at position 1079 is Trp, Tyr, Phe, Met, His, Ile Leu, Val, Ala, or Gly
  SITE (1081)..(1081): Xaa at position 1081 is Val, Ala, Gly, Leu, or Ile
  SITE (1085)..(1085): Xaa at position 1085 is Ala, Gly, or Pro
  SITE (1097)..(1097): Xaa at position 1097 is Ile, Ala, Val, Leu, or Gly
  SITE (1108)..(1108): Xaa at position 1108 is Leu, Ala, Val, Gly, or Ile
  SITE (1109)..(1109): Xaa at position 1109 is Val, Ala, Gly, Leu, or Ile
  SITE (1120)..(1120): Xaa at position 1120 is Leu, Ala, Val, Gly, or Ile
  SITE (1130)..(1130): Xaa at position 1130 is Leu, Ala, Val, Gly, or Ile
  SITE (1132)..(1132): Xaa at position 1132 is Leu, Ala, Val, Gly, or Ile
  SITE (1140)..(1140): Xaa at position 1140 is Ile, Ala, Val, Leu, or Gly
  SITE (1142)..(1142): Xaa at position 1142 is Val, Ala, Gly, Leu, or Ile
  SITE (1158)..(1158): Xaa at position 1158 is Val, Ala, Gly, Leu, or Ile
  SITE (1161)..(1161): Xaa at position 1161 is Leu, Ala, Val, Gly, or Ile
  SITE (1169)..(1169): Xaa at position 1169 is Leu, Ala, Val, Gly, or Ile
  SITE (1171)..(1171): Xaa at position 1171 is Cys, Ala, Val, Gly, Ser, or Thr
  SITE (1176)..(1176): Xaa at position 1176 is Ala, Gly, or Pro
  SITE (1177)..(1177): Xaa at position 1177 is Val, Ala, Gly, Leu, or Ile
  SITE (1179)..(1179): Xaa at position 1179 is Ile, Ala, Val, Leu, or Gly
  SITE (1180)..(1180): Xaa at position 1180 is Phe, Tyr, Met, His, Ile, Leu Val, Ala, or Gly
  SITE (1190)..(1190): Xaa at position 1190 is Ala, Gly, or Pro
  SITE (1192)..(1192): Xaa at position 1192 is Ala, Gly, or Pro
  SITE (1193)..(1193): Xaa at position 1193 is Val, Ala, Gly, Leu, or Ile
  SITE (1195)..(1195): Xaa at position 1195 is Phe, Tyr, Met, His, Ile, Leu Val, Ala, or Gly
  SITE (1196)..(1196): Xaa at position 1196 is Val, Ala, Gly, Leu, or Ile
  SITE (1198)..(1198): Xaa at position 1198 is Val, Ala, Gly, Leu, or Ile
  SITE (1201)..(1201): Xaa at position 1201 is Met, Ile, Leu, Val, Ala, or Gly
  SITE (1244)..(1244): Xaa at position 1244 is Tyr, Phe, Met, His, Ile, Leu Val, Ala, or Gly
  SITE (1251)..(1251): Xaa at position 1251 is Val, Ala, Gly, Leu, or Ile
  SITE (1253)..(1253): Xaa at position 1253 is Val, Ala, Gly, Leu, or Ile
  SITE (1254)..(1254): Xaa at position 1254 is Leu, Ala, Val, Gly, or Ile
  SITE (1259)..(1259): Xaa at position 1259 is Ala, Gly, or Pro
  SITE (1260)..(1260): Xaa at position 1260 is Ala, Gly, or Pro
  SITE (1268)..(1268): Xaa at position 1268 is Met, Ile, Leu, Val, Ala, or Gly
  SITE (1291)..(1291): Xaa at position 1291 is Ile, Ala, Val, Leu, or Gly
  SITE (1293)..(1293): Xaa at position 1293 is Tyr, Phe, Met, His, Ile, Leu Val, Ala, or Gly
  SITE (1296)..(1296): Xaa at position 1296 is Tyr, Phe, Met, His, Ile, Leu Val, Ala, or Gly
  SITE (1301)..(1301): Xaa at position 1301 is Ala, Gly, or Pro
  SITE (1312)..(1312): Xaa at position 1312 is Ile, Ala, Val, Leu, or Gly
  SITE (1314)..(1314): Xaa at position 1314 is Ile, Ala, Val, Leu, or Gly
  SITE (1315)..(1315): Xaa at position 1315 is Cys, Ala, Val, Gly, Ser, or Thr
  SITE (1318)..(1318): Xaa at position 1318 is Cys, Ala, Val, Gly, Ser, or Thr
  SITE (1326)..(1326): Xaa at position 1326 is Ile, Ala, Val, Leu, or Gly
  SITE (1327)..(1327): Xaa at position 1327 is Leu, Ala, Val, Gly, or Ile
  SITE (1329)..(1329): Xaa at position 1329 is Ile, Ala, Val, Leu, or Gly
  SITE (1332)..(1332): Xaa at position 1332 is Val, Ala, Gly, Leu, or Ile
  SITE (1336)..(1336): Xaa at position 1336 is Ala, Gly, or Pro
  SITE (1341)..(1341): Xaa at position 1341 is Ala, Gly, or Pro
  SITE (1343)..(1343): Xaa at position 1343 is Leu, Ala, Val, Gly, or Ile
  SITE (1344)..(1344): Xaa at position 1344 is Val, Ala, Gly, Leu, or Ile
  SITE (1345)..(1345): Xaa at position 1345 is Val, Ala, Gly, Leu, or Ile
  SITE (1346)..(1346): Xaa at position 1346 is Leu, Ala, Val, Gly, or Ile
  SITE (1347)..(1347): Xaa at position 1347 is Ala, Gly, or Pro
  SITE (1373)..(1373): Xaa at position 1373 is Ile, Ala, Val, Leu, or Gly
  SITE (1375)..(1375): Xaa at position 1375 is Phe, Tyr, Met, His, Ile, Leu Val, Ala, or Gly
  SITE (1380)..(1380): Xaa at position 1380 is Ile, Ala, Val, Leu, or Gly
  SITE (1385)..(1385): Xaa at position 1385 is Ile, Ala, Val, Leu, or Gly
  SITE (1391)..(1391): Xaa at position 1391 is Leu, Ala, Val, Gly, or Ile
  SITE (1392)..(1392): Xaa at position 1392 is Ile, Ala, Val, Leu, or Gly
  SITE (1393)..(1393): Xaa at position 1393 is Phe, Tyr, Met, His, Ile, Leu Val, Ala, or Gly
  SITE (1394)..(1394): Xaa at position 1394 is Cys, Ala, Val, Gly, Ser, or Thr
  SITE (1400)..(1400): Xaa at position 1400 is Cys, Ala, Val, Gly, Ser, or Thr
  SITE (1403)..(1403): Xaa at position 1403 is Leu, Ala, Val, Gly, or Ile
  SITE (1407)..(1407): Xaa at position 1407 is Leu, Ala, Val, Gly, or Ile
  SITE (1432)..(1432): Xaa at position 1432 is Val, Ala, Gly, Leu, or Ile
  SITE (1434)..(1434): Xaa at position 1434 is Val, Ala, Gly, Leu, or Ile
  SITE (1435)..(1435): Xaa at position 1435 is Val, Ala, Gly, Leu, or Ile
  SITE (1436)..(1436): Xaa at position 1436 is Ala, Gly, or Pro
  SITE (1440)..(1440): Xaa at position 1440 is Leu, Ala, Val, Gly, or Ile
  SITE (1444)..(1444): Xaa at position 1444 is Phe, Tyr, Met, His, Ile, Leu Val, Ala, or Gly
  SITE (1448)..(1448): Xaa at position 1448 is Phe, Tyr, Met, His, Ile, Leu Val, Ala, or Gly
  SITE (1451)..(1451): Xaa at position 1451 is Val, Ala, Gly, Leu, or Ile
  SITE (1452)..(1452): Xaa at position 1452 is Ile, Ala, Val, Leu, or Gly
  SITE (1470)..(1470): Xaa at position 1470 is Phe, Tyr, Met, His, Ile, Leu Val, Ala, or Gly
  SITE (1481)..(1481): Xaa at position 1481 is Ala, Gly, or Pro
  SITE (1499)..(1499): Xaa at position 1499 is Tyr, Phe, Met, His, Ile, Leu Val, Ala, or Gly
  SITE (1517)..(1517): Xaa at position 1517 is Leu, Ala, Val, Gly, or Ile
  SITE (1518)..(1518): Xaa at position 1518 is Cys, Ala, Val, Gly, Ser, or Thr
  SITE (1520)..(1520): Xaa at position 1520 is Cys, Ala, Val, Gly, Ser, or Thr
  SITE (1521)..(1521): Xaa at position 1521 is Tyr, Phe, Met, His, Ile, Leu Val, Ala, or Gly
  SITE (1526)..(1526): Xaa at position 1526 is Ala, Gly, or Pro
  SITE (1528)..(1528): Xaa at position 1528 is Tyr, Phe, Met, His, Ile, Leu Val, Ala, or Gly
  SITE (1539)..(1539): Xaa at position 1539 is Leu, Ala, Val, Gly, or Ile
  SITE (1542)..(1542): Xaa at position 1542 is Tyr, Phe, Met, His, Ile, Leu Val, Ala, or Gly
  SITE (1555)..(1555): Xaa at position 1555 is Leu, Ala, Val, Gly, or Ile
  SITE (1558)..(1558): Xaa at position 1558 is Trp, Tyr, Phe, Met, His, Ile Leu, Val, Ala, or Gly
  SITE (1561)..(1561): Xaa at position 1561 is Val, Ala, Gly, Leu, or Ile
  SITE (1568)..(1568): Xaa at position 1568 is Ile, Ala, Val, Leu, or Gly
  SITE (1572)..(1572): Xaa at position 1572 is Phe, Tyr, Met, His, Ile, Leu Val, Ala, or Gly
  SITE (1586)..(1586): Xaa at position 1586 is Leu, Ala, Val, Gly, or Ile
  SITE (1587)..(1587): Xaa at position 1587 is Val, Ala, Gly, Leu, or Ile
  SITE (1588)..(1588): Xaa at position 1588 is Ala, Gly, or Pro
  SITE (1591)..(1591): Xaa at position 1591 is Ala, Gly, or Pro
  SITE (1594)..(1594): Xaa at position 1594 is Cys, Ala, Val, Gly, Ser, or Thr
  SITE (1608)..(1608): Xaa at position 1608 is Trp, Tyr, Phe, Met, His, Ile Leu, Val, Ala, or Gly
  SITE (1611)..(1611): Xaa at position 1611 is Leu, Ala, Val, Gly, or Ile
  SITE (1619)..(1619): Xaa at position 1619 is His, Phe, Tyr, Lys, Arg, Gly Ser, Thr, Ala, Val, Leu, Ile, Asn, Met, or Gln
  SITE (1624)..(1624): Xaa at position 1624 is Leu, Ala, Val, Gly, or Ile
  SITE (1625)..(1625): Xaa at position 1625 is Leu, Ala, Val, Gly, or Ile
  SITE (1628)..(1628): Xaa at position 1628 is Leu, Ala, Val, Gly, or Ile
  SITE (1641)..(1641): Xaa at position 1641 is Ile, Ala, Val, Leu, or Gly
  SITE (1645)..(1645): Xaa at position 1645 is Ile, Ala, Val, Leu, or Gly
  SITE (2025)..(2025): Xaa at position 2025 is Met, Ile, Leu, Val, Ala, or Gly
  SITE (2029)..(2029): Xaa at position 2029 is Cys, Ala, Val, Gly, Ser, or Thr
  SITE (2035)..(2035): Xaa at position 2035 is Ile, Ala, Val, Leu, or Gly
  SITE (2052)..(2052): Xaa at position 2052 is Cys, Ala, Val, Gly, Ser, or Thr
  SITE (2060)..(2060): Xaa at position 2060 is Phe, Tyr, Met, His, Ile, Leu Val, Ala, or Gly
  SITE (2062)..(2062): Xaa at position 2062 is Ile, Ala, Val, Leu, or Gly
  SITE (2070)..(2070): Xaa at position 2070 is Cys, Ala, Val, Gly, Ser, or Thr
  SITE (2090)..(2090): Xaa at position 2090 is Tyr, Phe, Met, His, Ile, Leu Val, Ala, or Gly
  SITE (2091)..(2091): Xaa at position 2091 is Val, Ala, Gly, Leu, or Ile
  SITE (2093)..(2093): Xaa at position 2093 is Val, Ala, Gly, Leu, or Ile
  SITE (2102)..(2102): Xaa at position 2102 is Val, Ala, Gly, Leu, or Ile
  SITE (2105)..(2105): Xaa at position 2105 is Met, Ile, Leu, Val, Ala, or Gly
  SITE (2122)..(2122): Xaa at position 2122 is Phe, Tyr, Met, His, Ile, Leu Val, Ala, or Gly
  SITE (2128)..(2128): Xaa at position 2128 is Val, Ala, Gly, Leu, or Ile
  SITE (2147)..(2147): Xaa at position 2147 is Phe, Tyr, Met, His, Ile, Leu Val, Ala, or Gly
  SITE (2160)..(2160): Xaa at position 2160 is Leu, Ala, Val, Gly, or Ile
  SITE (2440)..(2440): Xaa at position 2440 is Leu, Ala, Val, Gly, or Ile
  SITE (2449)..(2449): Xaa at position 2449 is Leu, Ala, Val, Gly, or Ile
  SITE (2450)..(2450): Xaa at position 2450 is Leu, Ala, Val, Gly, or Ile
  SITE (2456)..(2456): Xaa at position 2456 is Val, Ala, Gly, Leu, or Ile
  SITE (2457)..(2457): Xaa at position 2457 is Tyr, Phe, Met, His, Ile, Leu Val, Ala, or Gly
  SITE (2458)..(2458): Xaa at position 2458 is Ala, Gly, or Pro
  SITE (2464)..(2464): Xaa at position 2464 is Ala, Gly, or Pro
  SITE (2483)..(2483): Xaa at position 2483 is Tyr, Phe, Met, His, Ile, Leu Val, Ala, or Gly
  SITE (2486)..(2486): Xaa at position 2486 is Val, Ala, Gly, Leu, or Ile
  SITE (2490)..(2490): Xaa at position 2490 is Met, Ile, Leu, Val, Ala, or Gly
  SITE (2492)..(2492): Xaa at position 2492 is Ala, Gly, or Pro
  SITE (2494)..(2494): Xaa at position 2494 is Ala, Gly, or Pro
  SITE (2497)..(2497): Xaa at position 2497 is Val, Ala, Gly, Leu, or Ile
  SITE (2499)..(2499): Xaa at position 2499 is Ala, Gly, or Pro
  SITE (2507)..(2507): Xaa at position 2507 is Ala, Gly, or Pro
  SITE (2508)..(2508): Xaa at position 2508 is Cys, Ala, Val, Gly, Ser, or Thr
  SITE (2522)..(2522): Xaa at position 2522 is Tyr, Phe, Met, His, Ile, Leu Val, Ala, or Gly
  SITE (2524)..(2524): Xaa at position 2524 is Ala, Gly, or Pro
  SITE (2527)..(2527): Xaa at position 2527 is Val, Ala, Gly, Leu, or Ile
  SITE (2534)..(2534): Xaa at position 2534 is Ala, Gly, or Pro
  SITE (2538)..(2538): Xaa at position 2538 is Ile, Ala, Val, Leu, or Gly
  SITE (2545)..(2545): Xaa at position 2545 is Leu, Ala, Val, Gly, or Ile
  SITE (2546)..(2546): Xaa at position 2546 is Leu, Ala, Val, Gly, or Ile
  SITE (2557)..(2557): Xaa at position 2557 is Ile, Ala, Val, Leu, or Gly
  SITE (2565)..(2565): Xaa at position 2565 is Cys, Ala, Val, Gly, Ser, or Thr
  SITE (2576)..(2576): Xaa at position 2576 is Ala, Gly, or Pro
  SITE (2578)..(2578): Xaa at position 2578 is Leu, Ala, Val, Gly, or Ile
  SITE (2580)..(2580): Xaa at position 2580 is Val, Ala, Gly, Leu, or Ile
  SITE (2584)..(2584): Xaa at position 2584 is Leu, Ala, Val, Gly, or Ile
  SITE (2586)..(2586): Xaa at position 2586 is Val, Ala, Gly, Leu, or Ile
  SITE (2588)..(2588): Xaa at position 2588 is Val, Ala, Gly, Leu, or Ile
  SITE (2589)..(2589): Xaa at position 2589 is Cys, Ala, Val, Gly, Ser, or Thr
  SITE (2593)..(2593): Xaa at position 2593 is Ala, Gly, or Pro
  SITE (2594)..(2594): Xaa at position 2594 is Leu, Ala, Val, Gly, or Ile
  SITE (2597)..(2597): Xaa at position 2597 is Val, Ala, Gly, Leu, or Ile
  SITE (2598)..(2598): Xaa at position 2598 is Val, Ala, Gly, Leu, or Ile
  SITE (2601)..(2601): Xaa at position 2601 is Leu, Ala, Val, Gly, or Ile
  SITE (2604)..(2604): Xaa at position 2604 is Ala, Gly, or Pro
  SITE (2605)..(2605): Xaa at position 2605 is Val, Ala, Gly, Leu, or Ile
  SITE (2610)..(2610): Xaa at position 2610 is Tyr, Phe, Met, His, Ile, Leu Val, Ala, or Gly
  SITE (2620)..(2620): Xaa at position 2620 is Val, Ala, Gly, Leu, or Ile
  SITE (2623)..(2623): Xaa at position 2623 is Leu, Ala, Val, Gly, or Ile
  SITE (2626)..(2626): Xaa at position 2626 is Ala, Gly, or Pro
  SITE (2634)..(2634): Xaa at position 2634 is Met, Ile, Leu, Val, Ala, or Gly
  SITE (2636)..(2636): Xaa at position 2636 is Phe, Tyr, Met, His, Ile, Leu Val, Ala, or Gly
  SITE (2638)..(2638): Xaa at position 2638 is Tyr, Phe, Met, His, Ile, Leu Val, Ala, or Gly
  SITE (2647)..(2647): Xaa at position 2647 is Val, Ala, Gly, Leu, or Ile
  SITE (2652)..(2652): Xaa at position 2652 is Ile, Ala, Val, Leu, or Gly
  SITE (2658)..(2658): Xaa at position 2658 is Ile, Ala, Val, Leu, or Gly
  SITE (2659)..(2659): Xaa at position 2659 is Tyr, Phe, Met, His, Ile, Leu Val, Ala, or Gly
  SITE (2661)..(2661): Xaa at position 2661 is Cys, Ala, Val, Gly, Ser, or Thr
  SITE (2662)..(2662): Xaa at position 2662 is Cys, Ala, Val, Gly, Ser, or Thr
  SITE (2665)..(2665): Xaa at position 2665 is Ala, Gly, or Pro
  SITE (2668)..(2668): Xaa at position 2668 is Ala, Gly, or Pro
  SITE (2671)..(2671): Xaa at position 2671 is Ala, Gly, or Pro
  SITE (2672)..(2672): Xaa at position 2672 is Ile, Ala, Val, Leu, or Gly
  SITE (2675)..(2675): Xaa at position 2675 is Leu, Ala, Val, Gly, or Ile
  SITE (2679)..(2679): Xaa at position 2679 is Leu, Ala, Val, Gly, or Ile
  SITE (2680)..(2680): Xaa at position 2680 is Tyr, Phe, Met, His, Ile, Leu Val, Ala, or Gly
  SITE (2685)..(2685): Xaa at position 2685 is Leu, Ala, Val, Gly, or Ile
  SITE (2693)..(2693): Xaa at position 2693 is Cys, Ala, Val, Gly, Ser, or Thr
  SITE (2698)..(2698): Xaa at position 2698 is Cys, Ala, Val, Gly, Ser, or Thr
  SITE (2700)..(2700): Xaa at position 2700 is Ala, Gly, or Pro
  SITE (2703)..(2703): Xaa at position 2703 is Val, Ala, Gly, Leu, or Ile
  SITE (2704)..(2704): Xaa at position 2704 is Leu, Ala, Val, Gly, or Ile
  SITE (2708)..(2708): Xaa at position 2708 is Cys, Ala, Val, Gly, Ser, or Thr
  SITE (2712)..(2712): Xaa at position 2712 is Leu, Ala, Val, Gly, or Ile
  SITE (2714)..(2714): Xaa at position 2714 is Cys, Ala, Val, Gly, Ser, or Thr
  SITE (2718)..(2718): Xaa at position 2718 is Ala, Gly, or Pro
  SITE (2719)..(2719): Xaa at position 2719 is Ala, Gly, or Pro
  SITE (2720)..(2720): Xaa at position 2720 is Ala, Gly, or Pro
  SITE (2721)..(2721): Xaa at position 2721 is Ala, Gly, or Pro
  SITE (2722)..(2722): Xaa at position 2722 is Cys, Ala, Val, Gly, Ser, or Thr
  SITE (2725)..(2725): Xaa at position 2725 is Ala, Gly, or Pro
  SITE (2727)..(2727): Xaa at position 2727 is Leu, Ala, Val, Gly, or Ile
  SITE (2732)..(2732): Xaa at position 2732 is Met, Ile, Leu, Val, Ala, or Gly
  SITE (2733)..(2733): Xaa at position 2733 is Leu, Ala, Val, Gly, or Ile
  SITE (2734)..(2734): Xaa at position 2734 is Val, Ala, Gly, Leu, or Ile
  SITE (2739)..(2739): Xaa at position 2739 is Leu, Ala, Val, Gly, or Ile
  SITE (2740)..(2740): Xaa at position 2740 is Val, Ala, Gly, Leu, or Ile
  SITE (2741)..(2741): Xaa at position 2741 is Val, Ala, Gly, Leu, or Ile
  SITE (2742)..(2742): Xaa at position 2742 is Ile, Ala, Val, Leu, or Gly
  SITE (2743)..(2743): Xaa at position 2743 is Cys, Ala, Val, Gly, Ser, or Thr
  SITE (2753)..(2753): Xaa at position 2753 is Ala, Gly, or Pro
  SITE (2755)..(2755): Xaa at position 2755 is Leu, Ala, Val, Gly, or Ile
  SITE (2758)..(2758): Xaa at position 2758 is Phe, Tyr, Met, His, Ile, Leu Val, Ala, or Gly
  SITE (2761)..(2761): Xaa at position 2761 is Ala, Gly, or Pro
  SITE (2762)..(2762): Xaa at position 2762 is Met, Ile, Leu, Val, Ala, or Gly
  SITE (2765)..(2765): Xaa at position 2765 is Tyr, Phe, Met, His, Ile, Leu Val, Ala, or Gly
  SITE (2767)..(2767): Xaa at position 2767 is Ala, Gly, or Pro
  SITE (2782)..(2782): Xaa at position 2782 is Ile, Ala, Val, Leu, or Gly
  SITE (2789)..(2789): Xaa at position 2789 is Val, Ala, Gly, Leu, or Ile
  SITE (2792)..(2792): Xaa at position 2792 is Ala, Gly, or Pro
  SITE (2801)..(2801): Xaa at position 2801 is Tyr, Phe, Met, His, Ile, Leu Val, Ala, or Gly
  SITE (2803)..(2803): Xaa at position 2803 is Leu, Ala, Val, Gly, or Ile
  SITE (2811)..(2811): Xaa at position 2811 is Leu, Ala, Val, Gly, or Ile
  SITE (2812)..(2812): Xaa at position 2812 is Ala, Gly, or Pro
  SITE (2814)..(2814): Xaa at position 2814 is Ala, Gly, or Pro
  SITE (2815)..(2815): Xaa at position 2815 is Ala, Gly, or Pro
  SITE (2828)..(2828): Xaa at position 2828 is Leu, Ala, Val, Gly, or Ile
  SITE (2831)..(2831): Xaa at position 2831 is Ile, Ala, Val, Leu, or Gly
  SITE (2832)..(2832): Xaa at position 2832 is Ile, Ala, Val, Leu, or Gly
  SITE (2835)..(2835): Xaa at position 2835 is Ala, Gly, or Pro
  SITE (2838)..(2838): Xaa at position 2838 is Leu, Ala, Val, Gly, or Ile
  SITE (2839)..(2839): Xaa at position 2839 is Trp, Tyr, Phe, Met, His, Ile Leu, Val, Ala, or Gly
  SITE (2840)..(2840): Xaa at position 2840 is Ala, Gly, or Pro
  SITE (2843)..(2843): Xaa at position 2843 is Ile, Ala, Val, Leu, or Gly
  SITE (2844)..(2844): Xaa at position 2844 is Leu, Ala, Val, Gly, or Ile
  SITE (2845)..(2845): Xaa at position 2845 is Met, Ile, Leu, Val, Ala, or Gly
  SITE (2847)..(2847): Xaa at position 2847 is His, Phe, Tyr, Lys, Arg, Gly Ser, Thr, Ala, Val, Leu, Ile, Asn, Met, or Gln
  SITE (2848)..(2848): Xaa at position 2848 is Phe, Tyr, Met, His, Ile, Leu Val, Ala, or Gly
  SITE (2849)..(2849): Xaa at position 2849 is Phe, Tyr, Met, His, Ile, Leu Val, Ala, or Gly
  SITE (2858)..(2858): Xaa at position 2858 is Leu, Ala, Val, Gly, or Ile
  SITE (2861)..(2861): Xaa at position 2861 is Ala, Gly, or Pro
  SITE (2864)..(2864): Xaa at position 2864 is Cys, Ala, Val, Gly, Ser, or Thr
  SITE (2866)..(2866): Xaa at position 2866 is Ile, Ala, Val, Leu, or Gly
  SITE (2869)..(2869): Xaa at position 2869 is Ala, Gly, or Pro
  SITE (2870)..(2870): Xaa at position 2870 is Cys, Ala, Val, Gly, Ser, or Thr
  SITE (2871)..(2871): Xaa at position 2871 is Tyr, Phe, Met, His, Ile, Leu Val, Ala, or Gly
  SITE (2873)..(2873): Xaa at position 2873 is Ile, Ala, Val, Leu, or Gly
  SITE (2876)..(2876): Xaa at position 2876 is Leu, Ala, Val, Gly, or Ile
  SITE (2878)..(2878): Xaa at position 2878 is Leu, Ala, Val, Gly, or Ile
  SITE (2881)..(2881): Xaa at position 2881 is Ile, Ala, Val, Leu, or Gly
  SITE (2882)..(2882): Xaa at position 2882 is Ile, Ala, Val, Leu, or Gly
  SITE (2885)..(2885): Xaa at position 2885 is Leu, Ala, Val, Gly, or Ile
  SITE (2890)..(2890): Xaa at position 2890 is Ala, Gly, or Pro
  SITE (2891)..(2891): Xaa at position 2891 is Phe, Tyr, Met, His, Ile, Leu Val, Ala, or Gly
  SITE (2904)..(2904): Xaa at position 2904 is Val, Ala, Gly, Leu, or Ile
  SITE (2905)..(2905): Xaa at position 2905 is Ala, Gly, or Pro
  SITE (2907)..(2907): Xaa at position 2907 is Cys, Ala, Val, Gly, Ser, or Thr
  SITE (2908)..(2908): Xaa at position 2908 is Leu, Ala, Val, Gly, or Ile
  SITE (2911)..(2911): Xaa at position 2911 is Leu, Ala, Val, Gly, or Ile
  SITE (2913)..(2913): Xaa at position 2913 is Val, Ala, Gly, Leu, or Ile
  SITE (2918)..(2918): Xaa at position 2918 is Val, Ala, Gly, Leu, or Ile
  SITE (2919)..(2919): Xaa at position 2919 is Trp, Tyr, Phe, Met, His, Ile Leu, Val, Ala, or Gly
  SITE (2923)..(2923): Xaa at position 2923 is Ala, Gly, or Pro
  SITE (2926)..(2926): Xaa at position 2926 is Val, Ala, Gly, Leu, or Ile
  SITE (2930)..(2930): Xaa at position 2930 is Leu, Ala, Val, Gly, or Ile
  SITE (2931)..(2931): Xaa at position 2931 is Leu, Ala, Val, Gly, or Ile
  SITE (2937)..(2937): Xaa at position 2937 is Ala, Gly, or Pro
  SITE (2938)..(2938): Xaa at position 2938 is Ala, Gly, or Pro
  SITE (2940)..(2940): Xaa at position 2940 is Cys, Ala, Val, Gly, Ser, or Thr
  SITE (2944)..(2944): Xaa at position 2944 is Leu, Ala, Val, Gly, or Ile
  SITE (2945)..(2945): Xaa at position 2945 is Phe, Tyr, Met, His, Ile, Leu Val, Ala, or Gly
  SITE (2948)..(2948): Xaa at position 2948 is Ala, Gly, or Pro
  SITE (2960)..(2960): Xaa at position 2960 is Ala, Gly, or Pro
  SITE (2961)..(2961): Xaa at position 2961 is Ala, Gly, or Pro
  SITE (2970)..(2970): Xaa at position 2970 is Phe, Tyr, Met, His, Ile, Leu Val, Ala, or Gly
  SITE (2972)..(2972): Xaa at position 2972 is Ala, Gly, or Pro
  SITE (2974)..(2974): Xaa at position 2974 is Tyr, Phe, Met, His, Ile, Leu Val, Ala, or Gly
  SITE (2979)..(2979): Xaa at position 2979 is Ile, Ala, Val, Leu, or Gly
MSTNPKPQRKTKRNTNRRPQDVKFPGGGQIVGGVYLLPRRGPRLGVRATRKTSERSQPRGRRQPIPKARQPEGRAWAQPGYPWPLYGNEGLGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTIPASAYEVRNVSGVYHVTNDCSNASIVYEAADMIMHTPGCVPCVRENNSSRCWVALTPTLAARNASVPTTTIRRHVDLLVGAAALCSAMYVGDLCGSVFLVAQLFTFSPRRHETVQDCNCSIYPGHVTGHRMAWDMMMNWSPTAALVVSQLLRIPQAVVDMVAGAHWGVLAGLAYYSMVGNWAKVLIVMLLFAGVDGGTYVTGGTMAKNTLGITSLFSPGSSQKIQLVNTNGSWHINRTALNCNDSLNTGFLAALFYVHKFNSSGCPERMASCSPIDAFAQGWGPITYNESHSSDQRPYCWHYAPRPCGIVPAAQVCGPVYCFTPSPVVVGTTDRFGVPTYSWGENETDVLLLNNTRPPQGNWFGCTWMNSTGFTKTCGGPPCNIGGIGNKTLTCPTDCFRKHPEATYTKCGSGPWLTPRCLVHYPYRLWHYPCTVNFTIFKVRMYVGGVEHRLEAACNWTRGERCNLEDRDRSELSPLLLSTTEWQVLPCSFTTLPALSTGLIHLHQNVVDVQYLYGIGSAVVSFAIKWEYVLLLFLLLADARVCACLWMMLLIAQAEAALENLVVXNAASVAGAHGILSFLVFFCAAWYIKGRLVPGAAYALYGVWPLLLLLLALPPRAYAMDREMAASCGGAVFVGLILLTLSPHYKLFLARLIWWLQYFITRAEAHLQVWIPPLNVRGGRDAVILLTCAIHPELIFTITKILLAILGPLMVLQAGITKVPYFVRAHGLIRACMLVRKVAGGHYVQMALMKLAALTGTYVYDHLTPLRDWAHAGLRDLAVAVEPVVFSDMETKVITWGADTAACGDIILGLPVSARRGREIHLGPADSLEGQGWRLLAPITAYSQQTRGLLGCIITSLTGRDRNQVEGEVQXVSTATQSFXXTXXNGXXXTXYHGXGSKTLAGPKGPXTQMYTNVDQDXXGWQAPPGARSXTPCTCGSSDXYXVTRHADVXPXRRRGDSRGSLLSPRPXSYXKGSSGGPXLXPSGHXXGXXRAAVCTRGVXKXXDXXPXESXETTMRSPVFTDNSSPPAVPQTFQVAHLHAPTGSGKSTKVPAAXAAQGYKXLXXNPSVXXTLGFGAYXSKAHGIDPNIRTGVRTITTGAPXTXSTXGKFLXDGGCSGGAYDXIXXDEXHSTDSTTXXGXGTXLDQXETAGXRXXXXXTATPPGSVTVPHPNIEEVALSSTGEXPXYGKAXPIETXKGGRHXXXXHSKKKXDEXAAKXSGLGLNAVAYYRGLDVSVIPTSGDXIXXXTDAXMTGXTGDXDSXXDCNTCVTQTVDFSLDPTXTIETTTVPQDXVSRSQRRGRTGRGRMGIXRFVTPGERPSGMFDSSVXXEXXDAGCXWXELTPAETSVRXRAXLNTPGLPVCQDHXEFXESXFTGLTHXDAHXLSQTKQAGDNFPYXXXYQXTVXARAQAPPPSWDQMXKCXIRLKPTLXGPTPXXYRXGAVQNEVTTTHPXTKYXMACMSADLEVVTSTWVLVGGVLAALAAYCLTTGSVVIVGRIILSGKPAIIPDREVLYREFDEMEECASHLPYIEQGMQLAEQFKQKAIGLLQTATKQAEAAAPVVESKWRTLEAFWAKHMWNFISGIQYLAGLSTLPGNPAIASLMAFTASITSPLTTQHTLLFNILGGWVAAQLAPPSAASAFVGAGIAGAAVGSIGLGKVLVDILAGYGAGVAGALVAFKVMSGEMPSTEDLVNLLPAILSPGALVVGVVCAAILRRHVGPGEGAVQWMNRLIAFASRGNHVSPTHYVPESDAAARVTQILSSLTITQLLKRLHQWINEDCSTPCSGSWLRDVWDWICTVLTDFKTWLQSKLLPRLPGVPFFSCQRGYKGVWRGDGIXQTTXPCGAQXTGHVKNGSMRIVGPRTXSNTWHGTXPXNAYTTGPXTPSPAPNYSRALWRVAAEEXXEXTRVGDFHYXTGXTTDNVKCPCQVPAPEFXTEVDGXRLHRYAPACKPLLREEVTXLVGLNQYLVGSQXPCEPEPDVAVLTSMLTDPSHITAETAKRRLARGSPPSLASSSASQLSAPSLKATCTTRHDSPDADLIEANLLWRQEMGGNITRVESENKVVILDSFEPLQAEEDEREVSVPAEILRRSRKFPRAMPIWARPDYNPPLLESWKDPDYVPPVVHGCPLPPAKAPPIPPPRRKRTVVLSESTVSSALAELATKTFGSSESSAVDSGTATASPDQPSDDGDAGSDVESYSSMPPLEGEPGDPDLSDGSWSTVSEEASEDVVCCSMSYTWTGALITPCAAEETKXPINALSNSXXRHHNLXXXTTSRSXSLRQKKVTFDRLQVLDDHXRDXLKEXKXKXSTXKXKLLSVEEXXKLTPPHSARSKFGXGXKDXRNLSSKXVNHXRSVWKDXXEDTETPIDTTXMAKNEVFXVQPEKGGRKPXRXIXFPDXGXRXXEKMXXYDXXSTXPQXXMGSSXGFQYSPGQRXEFXVNXWKAKKCPXGXAXDTRCFDSTXTENDXRVEESXXQXXDLXPEXRQXXRSXTERXXIGGPXTNSKGQNXGYRRXRXSGXXTTSXGNTXTXYLKXXXXXRAXKXQDCTXXXCGDDXXXXXESAGTQEDEXSXRAXTEXXTRXSXPPGDPPKPEYDLELXTSCSSNXSVXHDASGKRVXYXTRDPTTPXXRXXWETARHTPVNSWXGNXXMYXPTXXXRMXXXTXXXSILLAQEQXEKXLDXQXYGXXXSXEPXDXPQXXQRXHGLSXXSLHSYSPGEINRXXSXXRKXGXPPLRXXRHRXRSXRARXXSQGGRXXTXGKYXXNWXVRTKLKLTPIPXXSQLDLSSWXVXGXSGGDXYHSLSRARPRWFMWCLLLLSVGVGIYLLPNR

SEQ ID NO: 908 - protein, 285 aa, Homo sapiens
  SITE (112)..(112): Xaa at position 112 is Leu, Ala, Val, Gly, or Ile
  SITE (146)..(146): Xaa at position 146 is Cys, Ala, Val, Gly, Ser, or Thr
  SITE (147)..(147): Xaa at position 147 is Leu, Ala, Val, Gly, or Ile
  SITE (149)..(149): Xaa at position 149 is Leu, Ala, Val, Gly, or Ile
  SITE (166)..(166): Xaa at position 166 is Val, Ala, Gly, Leu, or Ile
  SITE (177)..(177): Xaa at position 177 is Ala, Gly, or Pro
  SITE (178)..(178): Xaa at position 178 is Leu, Ala, Val, Gly, or Ile
  SITE (185)..(185): Xaa at position 185 is Ile, Ala, Val, Leu, or Gly
  SITE (187)..(187): Xaa at position 187 is Val, Ala, Gly, Leu, or Ile
  SITE (193)..(193): Xaa at position 193 is Phe, Tyr, Met, His, Ile, Leu, Val Ala, or Gly
  SITE (194)..(194): Xaa at position 194 is Phe, Tyr, Met, His, Ile, Leu, Val Ala, or Gly
  SITE (195)..(195): Xaa at position 195 is Ile, Ala, Val, Leu, or Gly
  SITE (196)..(196): Xaa at position 196 is Tyr, Phe, Met, His, Ile, Leu, Val Ala, or Gly
  SITE (199)..(199): Xaa at position 199 is Val, Ala, Gly, Leu, or Ile
  SITE (201)..(201): Xaa at position 201 is Tyr, Phe, Met, His, Ile, Leu, Val Ala, or Gly
  SITE (208)..(208): Xaa at position 208 is Met, Ile, Leu, Val, Ala, or Gly
  SITE (210)..(210): Xaa at position 210 is His, Phe, Tyr, Lys, Arg, Gly, Ser Thr, Ala, Val, Leu, Ile, Asn, Met, or Gln
  SITE (212)..(212): Xaa at position 212 is Ile, Ala, Val, Leu, or Gly
  SITE (224)..(224): Xaa at position 224 is Leu, Ala, Val, Gly, or Ile
  SITE (226)..(226): Xaa at position 226 is Leu, Ala, Val, Gly, or Ile
  SITE (236)..(236): Xaa at position 236 is Met, Ile, Leu, Val, Ala, or Gly
  SITE (245)..(245): Xaa at position 245 is Cys, Ala, Val, Gly, Ser, or Thr
  SITE (248)..(248): Xaa at position 248 is Ala, Gly, or Pro
  SITE (253)..(253): Xaa at position 253 is Leu, Ala, Val, Gly, or Ile
  SITE (259)..(259): Xaa at position 259 is Leu, Ala, Val, Gly, or Ile
  SITE (261)..(261): Xaa at position 261 is Leu, Ala, Val, Gly, or Ile
  SITE (262)..(262): Xaa at position 262 is Ala, Gly, or Pro
  SITE (263)..(263): Xaa at position 263 is Ile, Ala, Val, Leu, or Gly
  SITE (268)..(268): Xaa at position 268 is Ala, Gly, or Pro
  SITE (276)..(276): Xaa at position 276 is Val, Ala, Gly, Leu, or Ile
  SITE (278)..(278): Xaa at position 278 is Phe, Tyr, Met, His, Ile, Leu, Val Ala, or Gly
  SITE (279)..(279): Xaa at position 279 is Phe, Tyr, Met, His, Ile, Leu, Val Ala, or Gly
  SITE (281)..(281): Xaa at position 281 is Ala, Gly, or Pro
  SITE (282)..(282): Xaa at position 282 is Leu, Ala, Val, Gly, or Ile
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGXKIFEPPAPGEGNSSQNSRNKRAVQGPEETVTQDXXQXIADSETPTIQKGSYTFXPWLLSFKRGSXXEEKENKXLXKETGYXXXXGQXLXTDKTYAXGXLXQRKKVHVFGDEXSXVTLFRCIQNXPETLPNNSXYSXGIAKXEEGDEXQXXXPRENXQISLDGDXTXXGXXKLL

SEQ ID NO: 909 - protein, 166 aa, Homo sapiens
  SITE (11)..(11): Xaa at position 11 is Val, Ala, Gly, Leu, or Ile
  SITE (14)..(14): Xaa at position 14 is Val, Ala, Gly, Leu, or Ile
  SITE (18)..(18): Xaa at position 18 is Met, Ile, Leu, Val, Ala, or Gly
  SITE (35)..(35): Xaa at position 35 is Ala, Gly, or Pro
  SITE (36)..(36): Xaa at position 36 is Val, Ala, Gly, Leu, or Ile
  SITE (37)..(37): Xaa at position 37 is Leu, Ala, Val, Gly, or Ile
  SITE (38)..(38): Xaa at position 38 is Phe, Tyr, Met, His, Ile, Leu, Val Ala, or Gly
  SITE (47)..(47): Xaa at position 47 is Ile, Ala, Val, Leu, or Gly
  SITE (48)..(48): Xaa at position 48 is Ile, Ala, Val, Leu, or Gly
  SITE (55)..(55): Xaa at position 55 is Ile, Ala, Val, Leu, or Gly
  SITE (57)..(57): Xaa at position 57 is Val, Ala, Gly, Leu, or Ile
  SITE (68)..(68): Xaa at position 68 is Tyr, Phe, Met, His, Ile, Leu, Val Ala, or Gly
  SITE (71)..(71): Xaa at position 71 is Phe, Tyr, Met, His, Ile, Leu, Val Ala, or Gly
  SITE (72)..(72): Xaa at position 72 is Val, Ala, Gly, Leu, or Ile
  SITE (75)..(75): Xaa at position 75 is Leu, Ala, Val, Gly, or Ile
  SITE (80)..(80): Xaa at position 80 is Cys, Ala, Val, Gly, Ser, or Thr
  SITE (82)..(82): Xaa at position 82 is Tyr, Phe, Met, His, Ile, Leu, Val Ala, or Gly
  SITE (83)..(83): Xaa at position 83 is Ala, Gly, or Pro
  SITE (84)..(84): Xaa at position 84 is Leu, Ala, Val, Gly, or Ile
  SITE (85)..(85): Xaa at position 85 is Tyr, Phe, Met, His, Ile, Leu, Val Ala, or Gly
  SITE (87)..(87): Xaa at position 87 is Ala, Gly, or Pro
  SITE (100)..(100): Xaa at position 100 is Val, Ala, Gly, Leu, or Ile
  SITE (101)..(101): Xaa at position 101 is Phe, Tyr, Met, His, Ile, Leu, Val Ala, or Gly
  SITE (104)..(104): Xaa at position 104 is Trp, Tyr, Phe, Met, His, Ile, Leu Val, Ala, or Gly
  SITE (109)..(109): Xaa at position 109 is Ala, Gly, or Pro
  SITE (117)..(117): Xaa at position 117 is Tyr, Phe, Met, His, Ile, Leu, Val Ala, or Gly
  SITE (124)..(124): Xaa at position 124 is Ile, Ala, Val, Leu, or Gly
  SITE (128)..(128): Xaa at position 128 is Phe, Tyr, Met, His, Ile, Leu, Val Ala, or Gly
  SITE (137)..(137): Xaa at position 137 is Val, Ala, Gly, Leu, or Ile
  SITE (149)..(149): Xaa at position 149 is Leu, Ala, Val, Gly, or Ile
  SITE (161)..(161): Xaa at position 161 is Leu, Ala, Val, Gly, or Ile
MASGVTVNDEXIKXFNDXKVRKSSTQEEIKKRKKXXXXCLSDDKRQXXVEEAKQXLXGDIGDTVEDPXTSXXKLXPLNDXRXXXXDXTYETKESKKEDLXXIFXAPESXPLKSKMIXASSKDAXKKKXTGIKHEWQXNGLDDIKDRSTXGEKLGGNVVVSXEGKPL

SEQ ID NO: 910 - protein, 125 aa, Homo sapiens
  SITE (11)..(11): Xaa at position 11 is Leu, Ala, Val, Gly, or Ile
  SITE (23)..(23): Xaa at position 23 is Leu, Ala, Val, Gly, or Ile
  SITE (24)..(24): Xaa at position 24 is Leu, Ala, Val, Gly, or Ile
  SITE (25)..(25): Xaa at position 25 is Leu, Ala, Val, Gly, or Ile
  SITE (42)..(42): Xaa at position 42 is Ala, Gly, or Pro
  SITE (46)..(46): Xaa at position 46 is Ala, Gly, or Pro
  SITE (81)..(81): Xaa at position 81 is Val, Ala, Gly, Leu, or Ile
  SITE (82)..(82): Xaa at position 82 is Ala, Gly, or Pro
  SITE (83)..(83): Xaa at position 83 is Ile, Ala, Val, Leu, or Gly
  SITE (89)..(89): Xaa at position 89 is Leu, Ala, Val, Gly, or Ile
  SITE (90)..(90): Xaa at position 90 is Leu, Ala, Val, Gly, or Ile
  SITE (91)..(91): Xaa at position 91 is Leu, Ala, Val, Gly, or Ile
  SITE (92)..(92): Xaa at position 92 is Cys, Ala, Val, Gly, Ser, or Thr
  SITE (93)..(93): Xaa at position 93 is Met, Ile, Leu, Val, Ala, or Gly
  SITE (104)..(104): Xaa at position 104 is Leu, Ala, Val, Gly, or Ile
  SITE (108)..(108): Xaa at position 108 is Ala, Gly, or Pro
MLRPKALTQVXSQANTGGVQSTXXXNNEGSLLAYSGYGDTDXRVTXAIASNIWAAYDRNGNQAFNEDNLKFILMDCMEGRXXXTRVANXXXXXYAKETVGFGMXKAKXQALVQYLEEPLTQVAAS

SEQ ID NO: 911 - protein, 699 aa, Homo sapiens
  SITE (15)..(15): Xaa at position 15 is Val, Ala, Gly, Leu, or Ile
  SITE (17)..(17): Xaa at position 17 is Val, Ala, Gly, Leu, or Ile
  SITE (18)..(18): Xaa at position 18 is Val, Ala, Gly, Leu, or Ile
  SITE (19)..(19): Xaa at position 19 is Val, Ala, Gly, Leu, or Ile
  SITE (46)..(46): Xaa at position 46 is Ile, Ala, Val, Leu, or Gly
  SITE (48)..(48): Xaa at position 48 is Val, Ala, Gly, Leu, or Ile
  SITE (76)..(76): Xaa at position 76 is Val, Ala, Gly, Leu, or Ile
  SITE (85)..(85): Xaa at position 85 is Ile, Ala, Val, Leu, or Gly
  SITE (88)..(88): Xaa at position 88 is Val, Ala, Gly, Leu, or Ile
  SITE (96)..(96): Xaa at position 96 is Ile, Ala, Val, Leu, or Gly
  SITE (98)..(98): Xaa at position 98 is Ala, Gly, or Pro
  SITE (110)..(110): Xaa at position 110 is Met, Ile, Leu, Val, Ala, or Gly
  SITE (122)..(122): Xaa at position 122 is Ile, Ala, Val, Leu, or Gly
  SITE (127)..(127): Xaa at position 127 is Phe, Tyr, Met, His, Ile, Leu, Val Ala, or Gly
  SITE (130)..(130): Xaa at position 130 is Ile, Ala, Val, Leu, or Gly
  SITE (149)..(149): Xaa at position 149 is Tyr, Phe, Met, His, Ile, Leu, Val Ala, or Gly
  SITE (150)..(150): Xaa at position 150 is Leu, Ala, Val, Gly, or Ile
  SITE (152)..(152): Xaa at position 152 is Ile, Ala, Val, Leu, or Gly
  SITE (157)..(157): Xaa at position 157 is Val, Ala, Gly, Leu, or Ile
  SITE (160)..(160): Xaa at position 160 is Leu, Ala, Val, Gly, or Ile
  SITE (195)..(195): Xaa at position 195 is Met, Ile, Leu, Val, Ala, or Gly
  SITE (216)..(216): Xaa at position 216 is His, Phe, Tyr, Lys, Arg, Gly, Ser Thr, Ala, Val, Leu, Ile, Asn, Met, or Gln
  SITE (224)..(224): Xaa at position 224 is Phe, Tyr, Met, His, Ile, Leu, Val Ala, or Gly
  SITE (226)..(226): Xaa at position 226 is Ile, Ala, Val, Leu, or Gly
  SITE (235)..(235): Xaa at position 235 is Ile, Ala, Val, Leu, or Gly
  SITE (246)..(246): Xaa at position 246 is Leu, Ala, Val, Gly, or Ile
  SITE (248)..(248): Xaa at position 248 is Leu, Ala, Val, Gly, or Ile
  SITE (249)..(249): Xaa at position 249 is Val, Ala, Gly, Leu, or Ile
  SITE (252)..(252): Xaa at position 252 is Ala, Gly, or Pro
  SITE (267)..(267): Xaa at position 267 is Leu, Ala, Val, Gly, or Ile
  SITE (283)..(283): Xaa at position 283 is Val, Ala, Gly, Leu, or Ile
  SITE (284)..(284): Xaa at position 284 is Ile, Ala, Val, Leu, or Gly
  SITE (302)..(302): Xaa at position 302 is Leu, Ala, Val, Gly, or Ile
  SITE (310)..(310): Xaa at position 310 is Leu, Ala, Val, Gly, or Ile
  SITE (318)..(318): Xaa at position 318 is Met, Ile, Leu, Val, Ala, or Gly
  SITE (319)..(319): Xaa at position 319 is Cys, Ala, Val, Gly, Ser, or Thr
  SITE (320)..(320): Xaa at position 320 is Ala, Gly, or Pro
  SITE (322)..(322): Xaa at position 322 is Ile, Ala, Val, Leu, or Gly
  SITE (325)..(325): Xaa at position 325 is Ala, Gly, or Pro
  SITE (336)..(336): Xaa at position 336 is Leu, Ala, Val, Gly, or Ile
  SITE (339)..(339): Xaa at position 339 is Ala, Gly, or Pro
  SITE (342)..(342): Xaa at position 342 is Ala, Gly, or Pro
  SITE (345)..(345): Xaa at position 345 is Ile, Ala, Val, Leu, or Gly
MPINKSEKPESCDNXKXXXRCRPLNEREKSMCYKQAVSVDEMRGTXTXHKTDSSNEPPKTFTFDTVFGPESKQLDXYNLTARPIXDSXLEGYNGTXFXYGQTGTGKTFTXEGVRAIPELRGXIPNSXAHXFGHIAKAEGDTRFLVRVSXXEXYNEEXRDXLGKDQTQRLEVKERPDVGVYIKDLSAYVVNNADDXDRIMTLGHKNRSVGATNMNEXSSRSHAIXTXTIECSEKGXDGNMHVRMGKXHXXDLXGSERQAKTGATGQRXKEATKINLSLSTLGNXXSALVDGKSTHVPYRNSKXTRLLQDSXGGNSKTMXXXNXGPXDYNYDETISTXRYXNRXKNXKNKARINEDPKDALLRQFQKEIEELKKKLEEGEEISGSDISGSEEDDDEEGEVGEDGEKRKKRRGKKKVSPDKMIEMQAKIDEERKALETKLDMEEEERNKARAELEKREKDLLKAQQEHQSLLEKLSALEKKVIVGGVDLLAKAEEQEKLLEESNMELEERRKRAEQLRRELEEKEQERLDIEEKYTSLQEEAQGKTKKLKKVWTMLMAAKSEMADLQQEHQREIEGLLENIRQLSRELRLQMLIIDNFIPRDYQEMIENYVHWNEDIGEWQLKCVAYTGNNMRKQTPVPDKKEKDPFEVDLSHVYLAYTEESLRQSLMKLERPRTSKGKARPKTGRRKRSAKPETVIDSLLQ

SEQ ID NO: 912 - protein, 1643 aa, Homo sapiens
  SITE (337)..(337): Xaa at position 337 is Phe, Tyr, Met, His, Ile, Leu, Val Ala, or Gly
  SITE (576)..(576): Xaa at position 576 is Leu, Ala, Val, Gly, or Ile
  SITE (582)..(582): Xaa at position 582 is Leu, Ala, Val, Gly, or Ile
  SITE (585)..(585): Xaa at position 585 is Leu, Ala, Val, Gly, or Ile
  SITE (711)..(711): Xaa at position 711 is Phe, Tyr, Met, His, Ile, Leu, Val Ala, or Gly
  SITE (824)..(824): Xaa at position 824 is Ile, Ala, Val, Leu, or Gly
  SITE (875)..(875): Xaa at position 875 is Phe, Tyr, Met, His, Ile, Leu, Val Ala, or Gly
  SITE (896)..(896): Xaa at position 896 is Phe, Tyr, Met, His, Ile, Leu, Val Ala, or Gly
  SITE (909)..(909): Xaa at position 909 is Leu, Ala, Val, Gly, or Ile
  SITE (949)..(949): Xaa at position 949 is Leu, Ala, Val, Gly, or Ile
  SITE (988)..(988): Xaa at position 988 is Leu, Ala, Val, Gly, or Ile
  SITE (993)..(993): Xaa at position 993 is Tyr, Phe, Met, His, Ile, Leu, Val Ala, or Gly
  SITE (1022)..(1022): Xaa at position 1022 is Val, Ala, Gly, Leu, or Ile
  SITE (1101)..(1101): Xaa at position 1101 is Ile, Ala, Val, Leu, or Gly
  SITE (1118)..(1118): Xaa at position 1118 is Leu, Ala, Val, Gly, or Ile
  SITE (1120)..(1120): Xaa at position 1120 is Val, Ala, Gly, Leu, or Ile
  SITE (1122)..(1122): Xaa at position 1122 is Phe, Tyr, Met, His, Ile, Leu Val, Ala, or Gly
  SITE (1130)..(1130): Xaa at position 1130 is Ile, Ala, Val, Leu, or Gly
  SITE (1131)..(1131): Xaa at position 1131 is Leu, Ala, Val, Gly, or Ile
  SITE (1132)..(1132): Xaa at position 1132 is Val, Ala, Gly, Leu, or Ile
  SITE (1134)..(1134): Xaa at position 1134 is Ile, Ala, Val, Leu, or Gly
  SITE (1144)..(1144): Xaa at position 1144 is Leu, Ala, Val, Gly, or Ile
  SITE (1146)..(1146): Xaa at position 1146 is Leu, Ala, Val, Gly, or Ile
  SITE (1148)..(1148): Xaa at position 1148 is Ile, Ala, Val, Leu, or Gly
  SITE (1153)..(1153): Xaa at position 1153 is Ile, Ala, Val, Leu, or Gly
  SITE (1155)..(1155): Xaa at position 1155 is Val, Ala, Gly, Leu, or Ile
  SITE (1157)..(1157): Xaa at position 1157 is Phe, Tyr, Met, His, Ile, Leu Val, Ala, or Gly
  SITE (1164)..(1164): Xaa at position 1164 is Ile, Ala, Val, Leu, or Gly
  SITE (1166)..(1166): Xaa at position 1166 is Ile, Ala, Val, Leu, or Gly
  SITE (1173)..(1173): Xaa at position 1173 is Val, Ala, Gly, Leu, or Ile
  SITE (1181)..(1181): Xaa at position 1181 is Val, Ala, Gly, Leu, or Ile
  SITE (1190)..(1190): Xaa at position 1190 is Ala, Gly, or Pro
  SITE (1192)..(1192): Xaa at position 1192 is Leu, Ala, Val, Gly, or Ile
  SITE (1194)..(1194): Xaa at position 1194 is Val, Ala, Gly, Leu, or Ile
  SITE (1199)..(1199): Xaa at position 1199 is Val, Ala, Gly, Leu, or Ile
  SITE (1209)..(1209): Xaa at position 1209 is Leu, Ala, Val, Gly, or Ile
  SITE (1212)..(1212): Xaa at position 1212 is Phe, Tyr, Met, His, Ile, Leu Val, Ala, or Gly
  SITE (1218)..(1218): Xaa at position 1218 is Ile, Ala, Val, Leu, or Gly
  SITE (1220)..(1220): Xaa at position 1220 is Ile, Ala, Val, Leu, or Gly
  SITE (1229)..(1229): Xaa at position 1229 is Phe, Tyr, Met, His, Ile, Leu Val, Ala, or Gly
  SITE (1233)..(1233): Xaa at position 1233 is Leu, Ala, Val, Gly, or Ile
  SITE (1236)..(1236): Xaa at position 1236 is Leu, Ala, Val, Gly, or Ile
  SITE (1238)..(1238): Xaa at position 1238 is Tyr, Phe, Met, His, Ile, Leu Val, Ala, or Gly
  SITE (1243)..(1243): Xaa at position 1243 is Val, Ala, Gly, Leu, or Ile
  SITE (1244)..(1244): Xaa at position 1244 is Leu, Ala, Val, Gly, or Ile
  SITE (1260)..(1260): Xaa at position 1260 is Val, Ala, Gly, Leu, or Ile
  SITE (1266)..(1266): Xaa at position 1266 is Val, Ala, Gly, Leu, or Ile
MSSTLHSVFFTLKVSILLGSLLGLCLGLEFMGLPNQWARYLRWDASTRSDLSFQFKTNVSTGLLLYLDDGGVCDFLCLSLVDGRVQLRFSMDCAETAVLSNKQVNDSSWHFLMVSRDRLRTVLMLDGEGQSGELQPQRPYMDVVSDLFLGGVPTDIRPSALTLDGVQAMPGFKGLILDLKYGNSEPRLLGSRGVQMDAEGPCGERPCENGGICFLLDGHPTCDCSTTGYGGKLCSEDVSQDPGLSHLMMSEQAREENVATFRGSEYLCYDLSQNPIQSSSDEITLSFKTWQRNGLILHTGKSADYVNLALKDGAVSLVINLGSGAFEAIVEPVNGKXNDNAWHDVKVTRNLRQVTISVDGILTTTGYTQEDYTMLGSDDFFYVGGSPSTADLPGSPVSNNFMGCLKEVVYKNNDIRLELSRLARIADTKMKIYGEVVFKCENVATLDPINFETPEAYISLPKWNTKRMGSISFDFRTTEPNGLILFTHGKPQERKDARSQKNTKVDFFAVELLDGNLYLLLDMGSGTIKVKATQKKANDGEWYHVDIQRDGRSGTISVNSRRTPFTASGESEILDXEGDMYXGGXPENRAGLILPTELWTAMLNYGYVGCIRDLFIDGRSKNIRQLAEMQNAAGVKSSCSRMSAKQCDSYPCKNNAVCKDGWNRFICDCTGTGYWGRTCEREASILSYDGSMYMKIIMPMVMHTEAEDVSXRFMSQRAYGLLVATTSRDSADTLRLELDGGRVKLMVNLDCIRINCNSSKGPETLYAGQKLNDNEWHTVRVVRRGKSLKLTVDDDVAEGTMVGDHTRLEFHNIETGIMTEKRYXSVVPSSFIGHLQSLMFNGLLYIDLCKNGDIDYCELKARFGLRNIIADPVTXKTKSSYLSLATLQAYTSMHLXFQFKTTSPDGFIXFNSGDGNDFIAVELVKGYIHYVFDLGNGPNVIKGNSDRPXNDNQWHNVVITRDNSNTHSLKVDTKVVTQVINGAKNLDXKGDLXMAGLAQGMYSNLPKLVASRDGFQGCLASXDLNGRLPDLINDALHRSGQIERGCEGPSTTCQEDSCANQGVCMQQWEGFTCDCSMTSYSGNQCNDPGATYIFGKSGGLXLYTWPANDRPSTRSDRXAXGXSTTVKDGXXXRXDSAPGLGDFXQXHXEQGKXGXVXNIGTVDXSXKEERTPXNDGKYHVXRFTRNGGNXTXQXDNWPXNEHYPTGRQXTIXNTQAQXAXGGKDKGRLXQGQXSGXYXDGLKXXNMAAENNPNIKINGSXRLVGEXPSILGTTQTTSMPPEMSTTVMETTTTMATTTTRKNRSTASIQPTSDDLVSSAECSSDDEDFVECEPSTTGGELVIPLLVEDPLATPPIATRAPSITLPPTFRPLLTIIETTKDSLSMTSEAGLPCLSDQGSDGCDDDGLVISGYGSGETFDSNLPPTDDEDFYTTFSLVTDKSLSTSIFEGGYKAHAPKWESKDFRPNKVSETSRTTTTSLSPELIRFTASSSSGMVPKLPAGKMNNRDLKPQPDIVLLPLPTAYELDSTKLKSPLITSPMFRNVPTANPTEPGIRRVPGASEVIRESSSTTGMVVGIVAAAALCILILLYAMYKYRNRDEGSYQVDETRNYISNSAQSNGTLMKEKQQSSKSGHKKQKNKDREYYV

SEQ ID NO: 913 - protein, 743 aa, Homo sapiens
  SITE (258)..(258): Xaa at position 258 is Cys, Ala, Val, Gly, Ser, or Thr
  SITE (266)..(266): Xaa at position 266 is Leu, Ala, Val, Gly, or Ile
  SITE (270)..(270): Xaa at position 270 is Cys, Ala, Val, Gly, Ser, or Thr
MIEDSGKRGNTMAERRQLFAEMRAQDLDRIRLSTYRTACKLRFVQKKCNLHLVDIWNVIEALRENALNNLDPNTELNVSRLEAVLSTIFYQLNKRMPTTHQIHVEQSISLLLNFLLAAFDPEGHGKISVFAVKMALATLCGGKIMDKLRYIFSMISDSSGVMVYGRYDQFLREVLKLPTAVFEGPSFGYTEQSARSCFSQQKKVTLNGFLDTLMSDPPPQCLVWLPLLHRLANVENVFHPVECSYCHSESMMGFRYRXQQCHNYQXCQDXFWRGHAGGSHSNQHQMKEYTSWKSPAKKLTNALSKSLSCASSREPLHPMFPDQPEKPLNLAHIVDTWPPRPVTSMNDTLFSHSVPSSGSPFITRSSPPKDSEVEQNKLLARAAPAFLKGKGIQYSLNVADRLADEHVLIGLYVNMLRNNPSCMLESSNRLDEEHRLIARYAARLAAESSSSQPPQQRSAPDISFTIDANKQQRQLIAELENKNREILQEIQRLRLEHEQASQPTPEKAQQNPTLLAELRLLRQRKDELEQRMSALQESRRELMVQLEGLMKLLKTQGAGSPRSSPSHTISRPIPMPIRSASACSTPTHTPQDSLTGVGGDVQEAFAQSSRRNLRNDLLVAADSITNTMSSLVKELNSEVGSETESNVDSEFARTQFEDLVPSPTSEKAFLAQIHARKPGYIHSGATTSTMRGDMVTEDADPYVQPEDENYENDSVRQLENELQMEEYLKQKLQDEAYQVSLQG

SEQ ID NO: 914 - protein, 254 aa, Homo sapiens
  SITE (31)..(31): Xaa at position 31 is Ile, Ala, Val, Leu, or Gly
  SITE (46)..(46): Xaa at position 46 is Ala, Gly, or Pro
  SITE (47)..(47): Xaa at position 47 is Ala, Gly, or Pro
  SITE (48)..(48): Xaa at position 48 is Leu, Ala, Val, Gly, or Ile
  SITE (59)..(59): Xaa at position 59 is Val, Ala, Gly, Leu, or Ile
  SITE (60)..(60): Xaa at position 60 is Leu, Ala, Val, Gly, or Ile
  SITE (66)..(66): Xaa at position 66 is Val, Ala, Gly, Leu, or Ile
  SITE (67)..(67): Xaa at position 67 is Leu, Ala, Val, Gly, or Ile
  SITE (69)..(69): Xaa at position 69 is Ala, Gly, or Pro
  SITE (72)..(72): Xaa at position 72 is Cys, Ala, Val, Gly, Ser, or Thr
  SITE (79)..(79): Xaa at position 79 is Ile, Ala, Val, Leu, or Gly
  SITE (81)..(81): Xaa at position 81 is Leu, Ala, Val, Gly, or Ile
  SITE (83)..(83): Xaa at position 83 is Leu, Ala, Val, Gly, or Ile
  SITE (99)..(99): Xaa at position 99 is Ala, Gly, or Pro
  SITE (114)..(114): Xaa at position 114 is Ala, Gly, or Pro
  SITE (117)..(117): Xaa at position 117 is Leu, Ala, Val, Gly, or Ile
  SITE (118)..(118): Xaa at position 118 is Met, Ile, Leu, Val, Ala, or Gly
  SITE (119)..(119): Xaa at position 119 is Leu, Ala, Val, Gly, or Ile
  SITE (132)..(132): Xaa at position 132 is Ile, Ala, Val, Leu, or Gly
  SITE (135)..(135): Xaa at position 135 is Ile, Ala, Val, Leu, or Gly
  SITE (148)..(148): Xaa at position 148 is Cys, Ala, Val, Gly, Ser, or Thr
  SITE (150)..(150): Xaa at position 150 is Val, Ala, Gly, Leu, or Ile
  SITE (153)..(153): Xaa at position 153 is Trp, Tyr, Phe, Met, His, Ile, Leu Val, Ala, or Gly
  SITE (168)..(168): Xaa at position 168 is Val, Ala, Gly, Leu, or Ile
  SITE (178)..(178): Xaa at position 178 is Cys, Ala, Val, Gly, Ser, or Thr
  SITE (192)..(192): Xaa at position 192 is Cys, Ala, Val, Gly, Ser, or Thr
  SITE (193)..(193): Xaa at position 193 is Ala, Gly, or Pro
  SITE (211)..(211): Xaa at position 211 is Leu, Ala, Val, Gly, or Ile
  SITE (213)..(213): Xaa at position 213 is Cys, Ala, Val, Gly, Ser, or Thr
  SITE (217)..(217): Xaa at position 217 is Leu, Ala, Val, Gly, or Ile
  SITE (220)..(220): Xaa at position 220 is Leu, Ala, Val, Gly, or Ile
  SITE (236)..(236): Xaa at position 236 is Val, Ala, Gly, Leu, or Ile
  SITE (237)..(237): Xaa at position 237 is Tyr, Phe, Met, His, Ile, Leu, Val Ala, or Gly
  SITE (240)..(240): Xaa at position 240 is Leu, Ala, Val, Gly, or Ile
MATAGNPWGWFLGYLILGVAGSLVSGSCSQXINGEDCSPHSQPWQXXXVMENELFCSGXXVHPQWXXSXAHXFQNSYTXGXGXHSLEADQEPGSQMVEXSLSVRHPEYNRPLLXNDXXXIKLDESVSESDTXRSXSIASQCPTAGNSXLXSGXGLLANGRMPTVLQCXNVSVVSEEVXSKLYDPLYHPSMFXXGGGHDQKDSCNGDSGGPXIXNGYXQGXVSFGKAPCGQVGVPGXXTNXCKFTEWIEKTVQAS

SEQ ID NO: 915 - protein, 639 aa, Homo sapiens
  SITE (4)..(4): Xaa at position 4 is Tyr, Phe, Met, His, Ile, Leu, Val Ala, or Gly
  SITE (6)..(6): Xaa at position 6 is Val, Ala, Gly, Leu, or Ile
  SITE (18)..(18): Xaa at position 18 is Leu, Ala, Val, Gly, or Ile
  SITE (20)..(20): Xaa at position 20 is Ile, Ala, Val, Leu, or Gly
  SITE (26)..(26): Xaa at position 26 is Ile, Ala, Val, Leu, or Gly
  SITE (38)..(38): Xaa at position 38 is Leu, Ala, Val, Gly, or Ile
  SITE (49)..(49): Xaa at position 49 is Phe, Tyr, Met, His, Ile, Leu, Val Ala, or Gly
  SITE (54)..(54): Xaa at position 54 is Val, Ala, Gly, Leu, or Ile
  SITE (113)..(113): Xaa at position 113 is Cys, Ala, Val, Gly, Ser, or Thr
  SITE (115)..(115): Xaa at position 115 is Val, Ala, Gly, Leu, or Ile
  SITE (127)..(127): Xaa at position 127 is Leu, Ala, Val, Gly, or Ile
  SITE (129)..(129): Xaa at position 129 is Leu, Ala, Val, Gly, or Ile
  SITE (135)..(135): Xaa at position 135 is Ile, Ala, Val, Leu, or Gly
  SITE (157)..(157): Xaa at position 157 is Phe, Tyr, Met, His, Ile, Leu, Val Ala, or Gly
  SITE (162)..(162): Xaa at position 162 is Val, Ala, Gly, Leu, or Ile
  SITE (274)..(274): Xaa at position 274 is Cys, Ala, Val, Gly, Ser, or Thr
  SITE (288)..(288): Xaa at position 288 is Leu, Ala, Val, Gly, or Ile
  SITE (290)..(290): Xaa at position 290 is Phe, Tyr, Met, His, Ile, Leu, Val Ala, or Gly
  SITE (296)..(296): Xaa at position 296 is Ile, Ala, Val, Leu, or Gly
  SITE (320)..(320): Xaa at position 320 is Phe, Tyr, Met, His, Ile, Leu, Val Ala, or Gly
  SITE (325)..(325): Xaa at position 325 is Ala, Gly, or Pro
MVDXIXEYDYDAVHDDEXTXRVGEIXRNVKKLQEEGWXEGELNGRRGMXPDNFXKEIKRETEFKDDSLPIKRERHGNVASLVQRISTYGLPAGGIQPHPQTKNIKKKTKKRQXKXLFEYIPQNEDEXEXKVGDIXDINEEVEEGWWSGTLNNKLGLXPSNFXKELEVTDDGETHEAQDDSETVLAGPTSPIPSLGNVSETASGSVTQPKKIRGIGFGDIFKEGSVKLRTRTSSSETEEKKPEKPLILQSLGPKTQSVEITKTDTEGKIKAKEYXRTLFAYEGTNEDEXTXKEGEIXHLISKETGEAGWWRGELNGKEGVXPDNFXVQINELDKDFPKPKKPPPPAKAPAPKPELIAAEKKYFSLKPEEKDEKSTLEQKPSKPAAPQVPPKKPTPPTKASNLLRSSGTVYPKRPEKPVPPPPPIAKINGEVSSISSKFETEPVSKLKLDSEQLPLRPKSVDFDSLTVRTSKETDVVNFDDIASSENLLHLTANRPKMPGRRLPGRFNGGHSPTHSPEKILKLPKEEDSANLKPSELKKDTCYSPKPSVYLSTPSSASKANTTAFLTPLEIKAKVETDDVKKNSLDELRAQIIELLCIVEALKKDHGKELEKLRKDLEEEKTMRSNLEMEIEKLKKAVLSS

SEQ ID NO: 916 - protein, 1785 aa, Homo sapiens
  SITE (654)..(654): Xaa at position 654 is Phe, Tyr, Met, His, Ile, Leu, Val Ala, or Gly
  SITE (679)..(679): Xaa at position 679 is Ala, Gly, or Pro
  SITE (711)..(711): Xaa at position 711 is Tyr, Phe, Met, His, Ile, Leu, Val Ala, or Gly
  SITE (722)..(722): Xaa at position 722 is Phe, Tyr, Met, His, Ile, Leu, Val Ala, or Gly
  SITE (739)..(739): Xaa at position 739 is Ala, Gly, or Pro
  SITE (769)..(769): Xaa at position 769 is Ala, Gly, or Pro
  SITE (776)..(776): Xaa at position 776 is Ile, Ala, Val, Leu, or Gly
  SITE (822)..(822): Xaa at position 822 is Ile, Ala, Val, Leu, or Gly
MQESQTKSMFVSRALEKILADKEVKRPQHSQLRRACQVALDEIKAEIEKQRLGTAAPPKANFIEADKYFLPFELACQSKSPRVVSTSLDCLQKLIAYGHITGNAPDSGAPGKRLIDRIVETICSCFQGPQTDEGVQLQIIKALLTAVTSPHIEIHEGTILQTVRTCYNIYLASKNLINQTTAKATLTQMLNVIFTRMENQVLQEARELEKPIQSKPQSPVIQAAAVSPKFVRLKHSQAQSKPTTPEKTDLTNGEHARSDSGKVSTENGDAPRERGSSLSGTDDGAQEVVKDILEDVVTSAIKEAAEKHGLTEPERVLGELECQECAIPPGVDENSQTNGIADDRQSLSSADNLESDAQGHQVAARFSHVLQKDAFLVFRSLCKLSMKPLGEGPPDPKSHELRSKVVSLQLLLSVLQNAGPVFRTHEMFINAIKQYLCVALSKNGVSSVPDVFELSLAIFLTLLSNFKMHLKMQIEVFFKEIFLNILETSTSSFEHRWMVIQTLTRICADAQCVVDIYVNYDCDLNAANIFERLVNDLSKIAQGRSGHELGMTPLQELSLRKKGLECLVSILKCMVEWSKDLYVNPNHQTSLGQERLTDQEIGDGKGLDMARRCSVTSMESTVSSGTQTTVQDDPEQFEVIKQQKEIIEHGIELXNKKPKRGIQFLQEQGMLGTSVEDIXQFLHQEERLDSTQVGDFLGDSARFNKEVMYAXVDQLDFCEKEXVSALRTFLEGFRLPGEXQKIDRLMEKFAARYIECNQGQTLFASADTXYVLAYSXIMLTTDLHSPQVKNKMTKEQYIKMNRGINDSKDLPEEYLSSIYEEXEGKKIAMKETKELTIATKSTKQNVASEKQRRLLYNLEMEQMAKTAKALMEAVSHAKAPFTSATHLDHVRPMFKLVWTPLLAAYSIGLQNCDDTEVASLCLEGIRCAIRIACIFGMQLERDAYVQALARFSLLTASSSITEMKQKNIDTIKTLITVAHTDGNYLGNSWHEILKCISQLELAQLIGTGVKTRYLSGSGREREGSLKGHTLAGEEFMGLGLGNLVSGGVDKRQMASFQESVGETSSQSVVVAVDRIFTGSTRLDGNAIVDFVRWLCAVSMDELASPHHPRMFSLQKIVEISYYNMNRIRLQWSRIWHVIGDHFNKVGCNPNEDVAIFAVDSLRQLSMKFLEKGELANFRFQKDFLRPFEHIMKKNRSPTIRDMAIRCIAQMVNSQAANIRSGWKNIFAVFHQAASDHDGNIVELAFQTTCHIVTTIFQHHFPAAIDSFQDAVKCLSEFACNAAFPDTSMEAIRLIRFCGKYVSERPRVLQEYTSDDMNVAPGDRVWVRGWFPILFELSCIINRCKLDVRTRGLTVMFEIMKSYGHTFEKHWWQDLFRIVFRIFDNMKLPEQLSEKSEWMTTTCNHALYAICDVFTQFYEALNEVLLSDVFAQLQWCVKQDNEQLARSGTNCLENLVISNGEKFSPEVWDETCNCMLDIFKTTIPHVLLTWRPVGMEEDSSEKHLDVDLDRQSLSSIDKNPSERGQSQLSNPTDDSWKGRPYANQKLFASLLIKCVVQLELIQTIDNIVFYPATSKKEDAEHMVAAQQDTLDADIHIETEDQGMYKYMSSQHLFKLLDCLQESHSFSKAFNSNYEQRTVLWRAGFKGKSKPNLLKQETSSLACCLRILFRMYVDENRRDSWEEIQQRLLTVCSEALAYFITVNSESHREAWTSLLLLLLTKTLKINDEKFKAHASMYYPYLCEIMQFDLIPELRAVLRKFFLRIGVVYKIWIPEEPSQVPAALSPVW

SEQ ID NO: 917 - protein, 788 aa, Homo sapiens
  SITE (63)..(63): Xaa at position 63 is Leu, Ala, Val, Gly, or Ile
  SITE (102)..(102): Xaa at position 102 is Phe, Tyr, Met, His, Ile, Leu, Val Ala, or Gly
  SITE (111)..(111): Xaa at position 111 is Ile, Ala, Val, Leu, or Gly
  SITE (113)..(113): Xaa at position 113 is Ala, Gly, or Pro
  SITE (117)..(117): Xaa at position 117 is Ile, Ala, Val, Leu, or Gly
  SITE (127)..(127): Xaa at position 127 is Leu, Ala, Val, Gly, or Ile
  SITE (131)..(131): Xaa at position 131 is Ala, Gly, or Pro
  SITE (147)..(147): Xaa at position 147 is Val, Ala, Gly, Leu, or Ile
  SITE (148)..(148): Xaa at position 148 is Ile, Ala, Val, Leu, or Gly
  SITE (150)..(150): Xaa at position 150 is Ile, Ala, Val, Leu, or Gly
  SITE (169)..(169): Xaa at position 169 is Val, Ala, Gly, Leu, or Ile
  SITE (182)..(182): Xaa at position 182 is Val, Ala, Gly, Leu, or Ile
  SITE (217)..(217): Xaa at position 217 is Ile, Ala, Val, Leu, or Gly
  SITE (218)..(218): Xaa at position 218 is Ile, Ala, Val, Leu, or Gly
  SITE (235)..(235): Xaa at position 235 is Val, Ala, Gly, Leu, or Ile
  SITE (237)..(237): Xaa at position 237 is Ile, Ala, Val, Leu, or Gly
  SITE (239)..(239): Xaa at position 239 is Ala, Gly, or Pro
  SITE (255)..(255): Xaa at position 255 is Val, Ala, Gly, Leu, or Ile
  SITE (257)..(257): Xaa at position 257 is Ile, Ala, Val, Leu, or Gly
  SITE (293)..(293): Xaa at position 293 is Ala, Gly, or Pro
  SITE (317)..(317): Xaa at position 317 is Phe, Tyr, Met, His, Ile, Leu, Val Ala, or Gly
  SITE (346)..(346): Xaa at position 346 is Leu, Ala, Val, Gly, or Ile
  SITE (348)..(348): Xaa at position 348 is Val, Ala, Gly, Leu, or Ile
  SITE (350)..(350): Xaa at position 350 is Ala, Gly, or Pro
  SITE (371)..(371): Xaa at position 371 is Val, Ala, Gly, Leu, or Ile
  SITE (373)..(373): Xaa at position 373 is Ile, Ala, Val, Leu, or Gly
MTIHQFLLLFLFWVCLPHFCSPEIMFRRTPVPQQRILSSRVPRSDGKILHRQKRGWMWNQFFXLEEYTGSDYQYVGKLHSDQDKGDGSLKYILSGDGAGTLXIIDEKTGDXHXTRRXDREEKAFYTXRAQXINRRTLRPVEPESEFXXKXHDINDNEPTFPEEIYTASXPEMSVVGTSVVQXTATDADDPSYGNSARVIYSILQGQPYFSVEPETGXXRTALPNMNRENREQYQXVXQXKDMGGQMGGLSGTTTXNXTLTDVNDNPPRFPQNTIHLRVLESSPVGTAIGSVKXTDADTGKNAEVEYRIIDGDGTDMXDIVTEKDTQEGIITVKKPLDYESRRLYTXKXEXENTHVDPRFYYLGPFKDTTIXKXSIEDVDEPPVFSRSSYLFEVHEDIEVGTIIGTVMARDPDSISSPIRFSLDRHTDLDRIFNIHSGNGSLYTSKPLDRELSQWHNLTVIAAEINNPKETTRVAVFVRILDVNDNAPQFAVFYDTFVCENARPGQLIQTISAVDKDDPLGGQKFFFSLAAVNPNFTVQDNEDNTARILTRKNGFNRHEISTYLLPVVISDNDYPIQSSTGTLTIRVCACDSQGNMQSCSAEALLLPAGLSTGALIAILLCIIILLVIVVLFAALKRQRKKEPLILSKEDIRDNIVSYNDEGGGEEDTQAFDIGTLRNPAAIEEKKLRRDIIPETLFIPRRTPTAPDNTDVRDFINERLKEHDLDPTAPPYDSLATYAYEGNDSIAESLSSLESGTTEGDQNYDYLREWGPRFNKLAEMYGGGESDKDS

SEQ ID NO: 918 - protein, 616 aa, Homo sapiens
  SITE (47)..(47): Xaa at position 47 is Cys, Ala, Val, Gly, Ser, or Thr
  SITE (50)..(50): Xaa at position 50 is Cys, Ala, Val, Gly, Ser, or Thr
  SITE (113)..(113): Xaa at position 113 is Ala, Gly, or Pro
  SITE (114)..(114): Xaa at position 114 is Cys, Ala, Val, Gly, Ser, or Thr
  SITE (133)..(133): Xaa at position 133 is Cys, Ala, Val, Gly, Ser, or Thr
MAPRARRRRPLFALLLLCALLARLQVALQIAPPCTSEKHYEHLGRCXNKXEPGKYMSSKCTTTSDSVCLPCGPDEYLDSWNEEDKCLLHKVCDTGKALVAVVAGNSTTPRRCXXTAGYHWSQDCECCRRNTEXAPGLGAQHPLQLNKDTVCKPCLAGYFSDAFSSTDKCRPWTNCTFLGKRVEHHGTEKSDAVCSSSLPARKPPNEPHVYLPGLIILLLFASVALVAAIIFGVCYRKKGKALTANLWHWINEACGRLSGDKESSGDSCVSTHTANFGQQGACEGVLLLTLEEKTFPEDMCYPDQGGVCQGTCVGGGPYAQGEDARMLSLVSKTEIEEDSFRQMPTEDEYMDRPSQPTDQLLFLTEPGSKSTPPFSEPLEVGENDSLSQCFTGTQSTVGSESCNCTEPLCRTDWTPMSSENYLQKEVDSGHCPHWAASPSPNWADVCTGCRNPPGEDCEPLVGSPKRGPLPQCAYGMGLPPEEEASRTEARDQPEDGADGRLPSSARAGAGSGSSPGGQSPASGNVTGNSNSTFISSGQVMNFKGDIIVVYVSQTSQEGAAAAAEPMGRPVQEETLARRDSFAGNGPRFPDPCGGPEGLREPEKASRPVQEQGGAKA

SEQ ID NO: 919 - protein, 58 aa, Bos taurus [sequence omitted]

SEQ ID NO: 920 - protein, 58 aa, Bos taurus
RPDFCLEPPYTGPAKARIIRYFYNAKAGLCQTFVYGGARAKRNNFKSAEDCMRTCGGA

SEQ ID NO: 921 - protein, 58 aa, Bos taurus
RPDFCLEPPYTGPAAARIIRYFYNAKAGLCQTFVYGGARAKRNNFKSAEDCMRTCGGA

SEQ ID NO: 922 - protein, 58 aa, Bos taurus
RPDFCLEPPYTGPAAARIIRYAYNAKAGLCQTFVYGGARAKRNNFKSAEDCMRTCGGA

SEQ ID NO: 923 - protein, 58 aa, Bos taurus
RPDFCLEPPYTGPAAARIIRYFANAKAGLCQTFVYGGARAKRNNFKSAEDCMRTCGGA

SEQ ID NO: 924 - protein, 58 aa, Bos taurus
RPDFCLEPPYTGPAAARIIRYFYNAKAGLCQTFVYGGARAKRGNFKSAEDCMRTCGGA

SEQ ID NO: 925 - protein, 58 aa, Bos taurus
RPDFCLEPPYTGPAAARIIRYFYNAKAGLCQTFVYGGARAKRNNAKSAEDCMRTCGGA
